US007538206B2

(12) United States Patent
Cole

(10) Patent No.: US 7,538,206 B2
(45) Date of Patent: *May 26, 2009

(54) COMPARATIVE MYCOBACTERIAL GENEOMICS AS A TOOL FOR IDENTIFYING TARGETS FOR THE DIAGNOSIS, PROPHYLAXIS OR TREATMENT OF MYCOBACTERIOSES

(75) Inventor: Stewart Cole, Clamart (FR)

(73) Assignee: Institut Pasteur, Paris (FR)

( * ) Notice: Subject to any disclaimer, the term of this patent is extended or adjusted under 35 U.S.C. 154(b) by 384 days.

This patent is subject to a terminal disclaimer.

(21) Appl. No.: 10/468,356

(22) PCT Filed: Feb. 22, 2002

(86) PCT No.: PCT/IB02/01973

§ 371 (c)(1),
(2), (4) Date: Apr. 12, 2004

(87) PCT Pub. No.: WO02/074903

PCT Pub. Date: Sep. 26, 2002

(65) Prior Publication Data

US 2004/0197896 A1    Oct. 7, 2004

Related U.S. Application Data

(60) Provisional application No. 60/270,123, filed on Feb. 22, 2001.

(51) Int. Cl.
*C07H 21/02* (2006.01)
*C07H 23/04* (2006.01)
*A61K 39/04* (2006.01)
*C12N 1/00* (2006.01)

(52) U.S. Cl. .............. 536/23.7; 536/23.1; 536/24.3; 536/24.32; 435/243; 435/253.1; 424/234.1; 424/248.1

(58) Field of Classification Search .............. 424/9.1, 424/9.2, 184.1, 234.1, 248.1; 435/243, 253.1; 536/23.1, 23.7, 24.3, 24.32

See application file for complete search history.

(56) References Cited

U.S. PATENT DOCUMENTS

2003/0129601 A1    7/2003    Cole

FOREIGN PATENT DOCUMENTS

WO    WO 99/54487    10/1999

OTHER PUBLICATIONS

Lancet; "Randomised Controlled Trial of Single BCG, Repeated BCG, or Combined BCG and Killed Mycobacterium Leprae vaccine for Prevention of Leprosy and Tuberculosis in Malawi," (Jul. 6, 1996) 348: pp. 17-24.

Kirchheimer et al. "Attempts to Establish the Armadillo (Dasypus novemcinctus Linn.) as a Model for the Study of Leprosy," International Journal of Leprosy and Other Mycobacterial Diseases, vol. 39, No. 3, Jul.-Sep. 1971.

Franzblau; "Drug Susceptibility Testing of Mycobacterium Leprae in the BACTEC 460 System," Antimicrobial Agents and Chemotherapy, vol. 33, No. 12, Dec. 1989, pp. 2115-2117.

Wolf et al.; "Evolution of Aminoacyl-tRNA Synthetases—Analysis of Unique Domain Architectures and Phylogenetic Trees Reveals a Complex History of Horizontal Gene Transfer Events," 1999. pp. 689-710.

Tekaia, et al.; "Analysis of the Proteome of Mycobacterium Tuberculosis in Silico," Tubercle and Lung Disease (1999), pp. 329-342.

Philipp et al.; "Mycobacterial Genome Structure," Electrophoresis 1998, 19, pp. 573-576.

Stinear, et al.; "Comparative Genetic Analysis of Mycobacterium Ulcerans and Mycobacterium marinum Reveals Evidence of Recent Divergence", Journal of Bacteriology, Nov. 2000, pp. 6322-6330.

Marques et al.; "Mapping and Identification of the Major Cell Wall-Associated Components of Mycobacterium Leprae," Infection and Immunity, Jun. 1998, pp. 2625-2631.

Jungblut et al.; "Comparative Proteome Analysis of Mycobacterium Tuberculosis and Mycobacterium Bovis BCG Strains: Towards Functional Genomics of Microbial Pathogens," Molecular Microbiology (1999) 33(6), pp. 1103-1117.

Andersson et al.; "Insights into the Evolutionary Process of Genome Degradation," Current Opinion in Genetics & Development 1999, 9:664-671.

Andersson et al.; "The Genome Sequence of Rickettsia Prowazekii and the Origin of Mitochondria," Nature © Macmillan Publishers, vol. 396, Nov. 12, 1998.

Mizrahi et al.; "DNA Replication," Molecular Genetics of Mycobacteria 2000.

Gordon et al.; "New Insertion Sequences and a Novel Repeated Sequence in the Genome of Mycobacterium Tuberculosis H37Rv," Microbiology (1999), 145, pp. 881-892.

Poulet et al.; "Repeated DNA Sequences in Mycobacteria," Arch Microbiol (1995) 163: pp. 79-86.

Cole; "Learning From the Genome Sequence of Mycobacterium Tuberculosis H37Rv," FEBS Letters 452 (1999) pp. 7-10.

Ramakrishnan et al.; "Granuloma-Specific Expression of Mycobacterium Virulence Proteins from the Glycine-Rich PE-PGRS Family," Science, vol. 222, pp. 1436-1439, May 26, 2000.

(Continued)

*Primary Examiner*—Rodney P. Swartz
(74) *Attorney, Agent, or Firm*—Finnegan, Henderson, Farabow, Garrett & Dunner L.L.P.

(57) ABSTRACT

The present invention is directed to a method of selection of purified nucleotidic sequences or polynucleotides encoding proteins or part of proteins carrying at least an essential function for the survival or the virulence of *mycobacterium* species by a comparative genomic analysis of the sequence of the genome of *M. tuberculosis* aligned on the genome sequence of *M. leprae* and *M. tuberculosis* and *M. leprae* marker polypeptides of nucleotides encoding the polypeptides, and methods for using the nucleotides and the encoded polypeptides are disclosed.

6 Claims, 103 Drawing Sheets

OTHER PUBLICATIONS

Figure 3:
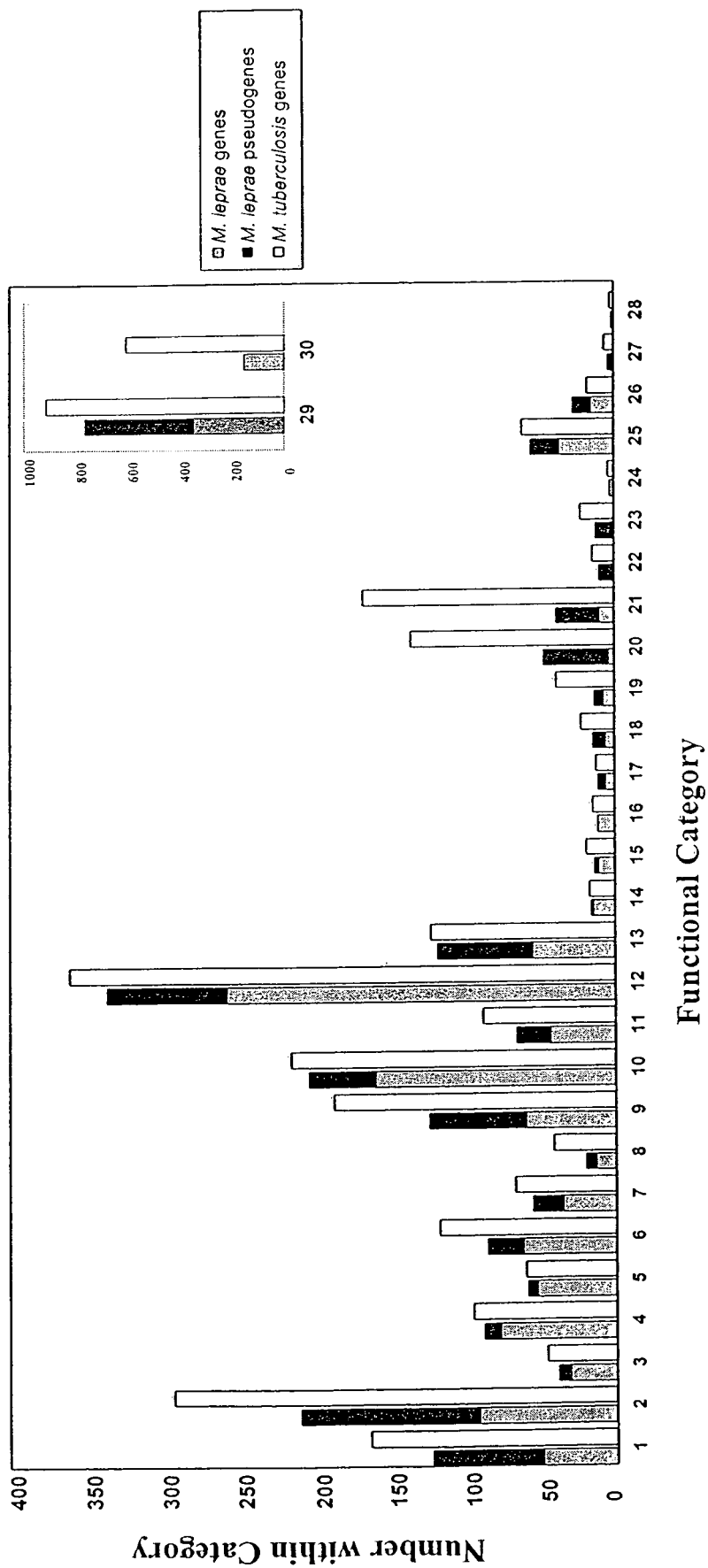

Daffé et al.; "The Envelope Layers of Mycobacteria with Reference to their Pathogenicity," Advances In Microbial Physiology, vol. 39, 1998.

Brosch et al.; "Genomic Analysis Reveals Variation between Mycobacterium Tuberculosis H37Rv and the Attenuated M. Tuberculosis H37Ra Strain," Infection and Immunity, pp. 5768-5774, Nov. 1999.

Yuan et al.; "A Common Mechanism for the Biosynthesis of Methoxy and Cyclopropyl Mycolic Acids in Mycobacterium Tuberculosis," Proc. Natl. Acad. Sci. USA, vol. 93, pp. 12828-12833, Nov. 1996.

Draper et al.; "The Mycolic Acids of Mycobacterium Leprae Harvested From Experimentally Injected Nine-Banded Armadillos," Ann. Microbiol. (Inst. Pasteur) 133 B, pp. 39-47. 1982.

Glickman et al.; "A Novel Mycolic Acid Cyclopropane Synthetase is Required for Cording, Persistence, and Virulence of Mycobacterium Tuberculosis," Molecular Cell, vol. 5, pp. 717-727, Apr. 2000.

Melancon-Kaplan et al.; "Immunological Significance of Mycobacterium Leprae Cell Walls," Proc. Natl. Acad. Sci. USA, vol. 85, pp. 1917-1921, Mar. 1998.

Cox et al.; "Complex Lipid Determines Tissue-Specific Replication of Mycobacterium Tuberculosis in Mice," Nature, vol. 402, Nov. 4, 1999.

Reinaldo et al.; "Identification of a Virulence Gene Cluster of Mycobacterium Tuberculosis by Signature-Tagged Transposon Mutagenesis," Molecular Microbiology 34(2), pp. 257-267, 1999.

Peterson et al.; "A Close Family Resemblance: the Importance of Structure in Understanding Cytochromes P450," Structure, 6:1079-1085, Sep. 15, 1998.

Bentrup et al.; "Characterization of Activity and Expression of Isocitrate Lyase in Mycobacterium avium and Mycobacterium tuberculosis," Journal of Bacteriology, pp. 7161-7167, Dec. 1999.

McKinney et al.; "Persistence of Mycobacterium Tuberculosis in Macrophages and Mice Requires the Glyoxylate Shunt Enzyme Isocitrate Lyase," Nature, vol. 406, Aug. 17, 2000.

Ratledge; "Lipids: Cell Composition, Fatty Acid Biosyntheses,"pp. 53-93, 1995.

De Voss et al.; "The Salicylate-Derived Mycobactin Siderophores of Mycobacterium Tuberculosis are Essential for Growth in Macrophages," PNAS, Vo. 97, No. 3, pp. 1252-1257, Feb. 1, 2000.

Quadri et al.; "Identification of a Mycobacterium Tuberculosis Gene Cluster Encoding the Biosynthetic Enzymes for Assembly of the Virulence-Conferring Siderophore Mycobactin," Chemistry & Biology, 5: pp. 631-645, , Nov. 1998.

Hall et al.; "Exchelin-mediated Iron Uptake into Mycobacterium Leprae," International Journal of Leprosy, vol. 51, No. 4, pp. 490-494, Jul. 7, 1983.

Shimoji et al.; "A 21-kDa Surface Protein of Mycobacterium Leprae Binds Peripheral Nerve Laminin-2 and Mediates Schwann Cell Invasion," Proc. Natl. Acad. Sci. USA, Vo. 96, pp. 9857-9862, Aug. 1999.

Rambukkana et al.; "Role of a-Dystroglycan as a Schwann Cell Receptor for Mycobacterium Leprae," Science, vol. 282, Dec. 11, 1998.

Rambukkana et al.; "Neural Targeting of Mycobacterium Leprae Mediated by the G Domain of the Laminin-a2 Chain," Cell Press, vol. 88, pp. 811-821, 1997.

Arruda et al.; "Cloning of an M. Tuberculosis DNA Fragment Associated with Entry and Survival Inside Cells," Science, vol. 261, Sep. 10, 1993.

Eiglmeier, et al.; "On the Catalase-Peroxidase Gene, katG, of Mycobacterium Leprae and the Implications for Treatment of Leprosy with Isoniazid," FEMA Microbiology Letters, pp. 273-278 (1997).

Andersen; "Host Responses and Antigens Involved in Protective Immunity to Mycobacterium Tuberculosis," Scandinavian Journal of Immunology, 45, pp. 115-131, (1997).

Pugsley; "The Complete General Secretory Pathway in Gram-Negative Bacteria," Microbiological Reviews, vol. 57, No. 1, pp. 50-108, Mar. 1993.

Stanley et al.; "The Twin Arginine Consensus Motif of Tat Slgnal Peptides Is Involved in Sec-independent Protein Targeting in *Escherichia coli*," The Journal of Biological Chemistry, vol. 275, No. 16, pp. 11591-11596, Apr. 21, 2000.

Berks et al.; "The Tat Protein Export Pathway," Molecular Microbiology 35(2) pp. 260-274, (2000).

Lalvani et al.; "Human Cytolytic and Interferon y-Secreting CD8 + T Lymphocytes Specifics for Mycobacterium Tuberculosis," Proc. Natl. Acad. Sci. USA, vol. 95 pp. 270-275, Jan. 1998.

Pollock et al.; "The Potential of the ESAT-6 Antigen Secreted by Virulent Mycobacteria for Specific Diagnosis of Tuberculosis," The Journal of Infectious Diseases, 175: pp. 1251-1254, (1997).

Harboe et al.; "Evidence for Occurrence of the ESAT-6 Protein in Mycobacterium Tuberculosis and Virulent Mycobacterium Bovis and for Its Absence in Mycobacterium Bovis BCG," Infection and Immunity, vol. 64, No. 1, pp. 16-22, Jan. 1996.

Mahairas et al.; "Molecular Analysis of Genetic Differences Between Mycobacterium Bovis BCG and Virulent M. Bovis," Journal of Bacteriology, vol. 178, No. 5, pp. 1274-1282, Mar. 1996.

Brandt et al.; "ESAT-6 Subunit Vaccination Against Mycobacterium Tuberculosis," Infection and Immunity, pp. 791-795, Feb. 2000.

Tekaia et al.; "Analysis of the Proteome of Mycobacterium Tuberculosis In Silico," Tubercle and Lung Disease, 79(6), pp. 329-342, (1999).

Eiglmeier et al.; "Use of an Ordered Cosmid Library to Deduce the Genomic Organization of Mycobacterium Leprae," Molecular Microbiology 7(2), pp. 197-206, (1993).

Parkhill et al.; "Complete DNA Sequence of a Serogroup A Strain of Neisseria Meningitidis Z2491," Nature, vol. 404, Mar. 30, 2000.

S. Noorden, J. Hombach; Leprosy; TDR Eleventh Programme Report, pp. 48-55, 1992.

Charles Shepard; Experimental Leprosy; Leprosy pp. 269-286, 1991.

R. Wheeler, C. Ratledge; Metabolism of *Mycobacterium tuberculosis, Tuberculosis*, Pathogenesis, Protection, and Control (1994) Chapter 23, pp. 353-385.

International Search Report for PCT/IB02/01973.

Cole et al.; Deciphering the biology of mycobacterium tuberculosis from the complete genome sequence; *Nature*, vol. 393 (1998) pp. 537-544.

Cole, Stewart; Comparative mycobacterial genomics; *Current Opinion in Microbiology*; vol. 1(5) (1998) pp. 567-571.

Brosch et al.; Comparative genomics of the leprosy and *tubercle bacilli; Res. Microbiol*. vol. 151(2) (2000) pp. 135-142.

Database EMBL; Mycobacterium leprae cosmid B1770; Database entry ID MLCB1770 (Aug. 29, 1997); Database Accession No. Z7072; XP-002241268.

Database EMBL; Mycobacterium leprae strain TN complete genome; segment 5/10; Database Accession No. AL583921; XP-002241269 (Feb. 20, 2001).

Cole et al.; Massive gene decay in the leprosy bacillus; *Nature*, vol. 409(6823) (Feb. 22, 2001) pp. 1007-1011.

FIGURE 1

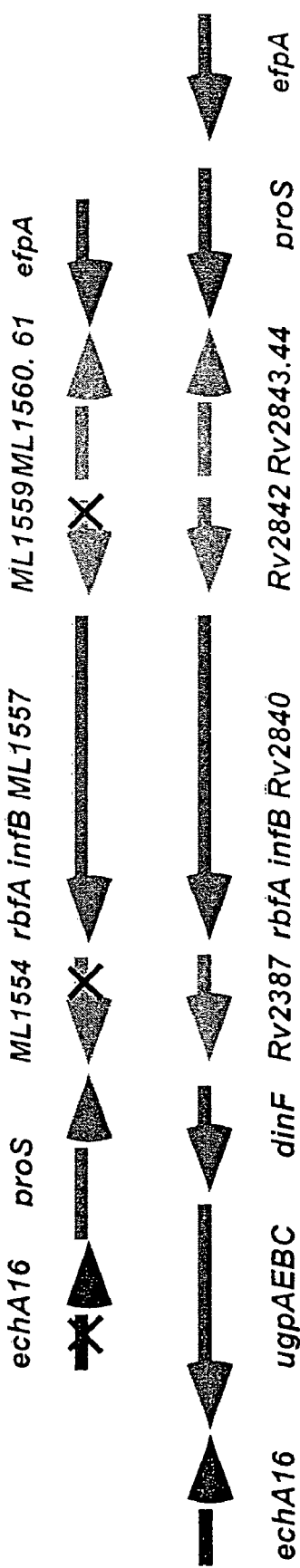
FIGURE 2A
FIGURE 2B

```
AAGCTTTTCGACCCGCAAGCCGGCGGTGCCCCTCCTCGTTCCGCTGCCCGGTCTGCTCGATCGGTTCGGGGTCGCCGCGC
TAGGCCCAATTGCCCGGCTCCTCCTCGGGCCGTTCCACGACCCGCATCGTCGCCGGGCTAGGTTCAAGCCATGCCGGTAG
ACCCCAGGACGCCAGTGCTGATCGGCTATGGACAGGTCAACCACCGAGGCGACATCGACGCCGAGAAGCAGTCCATCGAA
CCCGTCGACCTGATGGCCGCCGCGGCCCGGAAAGCCGCGGATTCGACGGTGCTCGAGGCGGTGGATTCGATCCGTGTGGT
GCACATGCTGTCGGCGCATTACCGGAATCCCGGGCAGCTCCTCGGCGAACGAATCAAGGCGAGGACCTTCACCACCGGTT
ACAGCGGGGTGGGCGGCAACATGCCGCAATCCCTGGTCAACCGGGCATGCCTGGACATCCAGCGCGGGCGGGCCGGCGTG
GTGCTGCTGGCTGGCGCCGAAACCTGGCGCACCCGAACGGGCCTGCGCGCCAAGGGCAGCAAACTGGAGTGGACTGTGCA
GGACGAATCCGTTCCGCTGCCGGACATGGCCGGCGACGACGTTCCGATGGCCGGTGCGGCTGAGCTGCGGATCAACCTGG
ACCGGCCGGCCTACGTGTACCCGATATTCGAGCAGGCGCTGCGCATCGCCTACGGCGAGTCGATCGAGAACCACCGAAAG
CGGATCGGCGAGCTGTGGGCGCGGTTCAGTGCCGTAGCTGCTGACAACCCGCACGCGTGGATCCGCAACCCGGTTACGGC
TGACGAGATCTGGCAGCCCGGCCCACAGAACCGGATGGTCAGCTGGCCCTACACCAAGCTTATGAACTCCAACAACATGG
TTGACCAGGGTGCCGCGCTGCTGCTGACGTCGGTCGAACGTGCGACACGTCTGCGAATACCGGCCGAACGCTGGGTTTAT
CCACAGGCTGGCACCGACGCCCACGACACACCGGCCGTCGCCGACCGCCACCGACTGCATCGGTCGACGGCCATTCGGAT
CGCCGGTGCCCGGGCGCTGGAACTGGCTGGGCTGGGGCTCGATGACATCGAATACGTCGACCTGTATTCGTGCTTTCCCT
CCGCTGTCCAAGTCGCCGCAATCGAACTCGGCCTGGACACCGACGATCCTGCCCGCCCGCTGACCGTCACCGGGGGCCTG
ACCTTCGCCGGCGGGCCGTGGAGCAATTACGTCACGCACTCCATCGCCACCATGGCTGAACTGCTGGCGGCCAATCCCGG
GCGCCGAGGCCTGATCACCGCCAACGGCGGTTACCTGACCAAACACAGTTTCGGGGTCTACGGCACCGAGCCGCCGTCGG
AATTCCGCTGGGAGGACATGCAACCCGCGGTCGATAGGGAGCCCACCGGAGATGGGTTGGTCGAGTGGGAAGGCATCGGC
ACCGTCGAAGCGTGGACCACACCAGTCAACCGGGACGGACAACCCGAGAAGGCGTTCCTGGCGGTGCGCACGCCCGACGG
GTCGCGCAGCTTGGCCGTGATCACCGATCCCGCATCGGTGCAAGCAACGGTGCGCGAGGACATCGCCGGCGTCAAGGTTG
CCGTCGCCCCGACGGCACCGCGACCCTGCGATAGCCGGCGGGCAGCACGAGTCACGTTCCAGAAGCAATGGTCGCGCAA
GCGACACTGACGTGCCTATTGTCATGAGGAGACGTTGGGGGAGGTGAGGCCGGGTGCAGATCCTGGTTACCGACGCCACG
GGTGCCGTCGGGCGGTCGGTCACTCGGCAGTTGATCGCTGCCGGACACACGGTGAGCGGTATAGCCCAGCACCCGCACGA
TGCTCTGGACCCCCGCGTCGACTATGTTTGCGCGTCGTTGCGCAACCCAGTGCTGCAAGAGTTAGCCGGCGAAGCCGACG
CGGTGATCCATCTCGCCCCGGTCGACACCAGCGCCCGGGCGGTGTTGGCATCACCGGACTGGCACATGTGGCCAACGCG
GCCGCCCGCGCCGGTGCCCGGCTGCTGTTCGTTTCTCAGGCCGCTGGGCGACCCGAACTATATCGGCAGGCTGAGACGCT
GGTGTCCACCGGTTGGGCACCCAGCTTGGTCATCCGTATTGCGCCACCGGTCGGCCGCCAACTCGATTGGATGGTGTGCC
GGACAGTGGCCACGCTGCTGCGGAGCAAAGTCTCGGCACGGCCGATACGAGTGCTACATCTCGACGACTTGGTCCGCTTC
CTGGTTTTGGCGCTGAATACCGACCGCAACGGTGTCCTGGCCACCCCTGACACCACCAATGTGGTCACCGCCGTG
GCGGCTGCTCCGATCCGTGGACCCGCACTTGCGAACACGTCGGGTCCGCAGCTGGGAGCAATTGATTCCCGAGGTGGATA
TCGCTGCCGTGCAGGAGGATTGGAACTTCGAGTTCGGCTGGCAAGCGACCGAAGCAATTGTCGACACCGGGCGGGGCCTC
GTCGGCCGCAGACTGCACCCGGCAGGCGCGACCAACGGATCGGTCAACTAGCACTGCCGGTGGAGGCGCCCCCGCGGTC
TGTGCCTTCCCACGGGGAACCCTTGGGCAGCGCGGCTCCAGAAGGGTTGGAGGGAGAGTTCGACGACCGTATCGACGAGC
GGTTCCCGGTCTTCAGCTCGGCCAGTCTCGCCGAAGCGCTGCCGGGTCCGCTGACCCCGATGACGCTGGATGTCCAGTTG
AGTGGACTGCCGCGGCCGGTGGGCGATGGGTCGGGTACTGGCGCTTGGCGGTGTCGTTGCCGATGAGTGGGAGAGAAG
AGCCATCGCGGTGTTCGGTCACCGCCCGTATATCGGAGTGTCGGCCAATATTGTGGCCGCCGCCCAACTGCCGGGGGTGGG
ACGCGCAGGCCGTAGCCCGGCGGGCACTGGGCGAGCAACCGCAGGTCACTGAGCTGCTTCCGTTTGGTCGACCGCAACTT
GCGGGCGGACCGCTCGGCTCGGTCGCGAAGGTGGTCGTGACGGCGCGGTCGCTGGCCCTGCTGCGCCATCTCCGGAGCGA
CACACACCACTATGTTGCCGCCGCAGATGCCGAGCACCTCGCTGCCGGGCAGCTTGCCTCGCTACCGGACGCCGGCTTGG
AGGTCCGGATTCGGCTGTTGCGTGATCGCATCCACCAAGGCTGGATTCTTACGGTGCTGTGGGTGATCGACACGGGCGTC
ACAGCGGCGACGTTAGAGCACACCCGCAGGCTCCGCGGTGTCCGGAGGGGGCATGATCATGGAAAGTGGCAGAATCGG
CGCCGAGATTGCTCCGCTGGCTGCGGTGCTGCGCGCCGTCGCGCGCTGGCCAACGACGGCAACCTCGCCA
GCATCCGCGCGCTGTCTGCTCCCGCCGCCGCAGTTGACGCGGTCATTGCCCGGATAGGGCACCGCGGGTTAGGCGAA
GCCGAGCTGGCTAACCTGACGTTTGCCGACGATCCGGCGCTACTGCTGAAGACAGCCGCCGAAATCGCCGCGCGGCCCGC
CGGGCCAGCTCACCCAGCGACGTTGATCCAGCGACTGGCTGCCGGCACGCGCAGTGCCCGGGAGCTGGCGCACGACACCA
CCATCCGATTCACCCATGAGCTCCGGATGACATTGCGGGAGTTGGGATCTCGACGAGTCGCGGCGGATGTGATAGACGTC
GTTGACGACGTGTTCTACCTGACCTGCGACGAACTGATTACCACGCCGGCCGACGCTCGGCTGCAATCAAACGTCGGCG
CGCCGAACGAGAACGCCTGCAGGCACAGCGCCCGCCAGACGTTATCGATCATGCCTGGGTACCCGTGGAGTAGCGGTCAA
CACACGTCAATTCGTCGTCAGGTCCGCCAACGGCCACTGCGGATCAACCAGCCTGTCAACGTCGACCGGGTTCCCGGACC
GGATCAGGCCCTTGACGTCGTCCACCACGTCCCAGACGTTGACATTCATCCCGGCTAGCACCCGGCTGTCGCCGTCGAGC
CAGAAGGAGAGGAACTCGCGGCCGGCAACGTTGCCACGGAACACCACCCGATCACAGCTGGGGGCGTGGCCGACGTACTC
CATGCCGAGGTCGTATTGATCGGTGAACAAATAGGGCAGTTCAGCGTATTCGCCCGGCCGGCCCAGCATGCCGGCAGCCG
CCACCGCGGGTTGTTTGAGCGCGTTGGCCCAGTGTTCGGTACGGACGCGGGTACCCAATAGCGGGTGTTCAGCGGCGGCA
ATGTCGCCGACTGCGTAGATGTCGGGATCGCTGGTGCGCAGCGATGCATCAACCAACACACCGCCCTCGCCCATCGCCAG
CCCGGCCTGTTGGGCGAGTTCTACGTTGGGCTTCGCGCCCACAGCGACTAGCACGGCGTCGGCGGCAACCGTCGACCCGT
CACGCATCTTGAGCCCGGTCGCCTTGCCGTCGGCTGCAGTGATCTCTTCGAGCTGGGTCTGCAACCGTAAGTCCACCCCT
```

FIGURE 4

```
TGATCTCGATGTAGGTCGGCAAACACTTTGCCAACCGCTTCCCCGAGCGCGGCCAGCAGCGGTTGTATGGCGGTCTCGAC
GACGGTGACGTCGACGCCACGTTGACGCGCACTGGCGGCCACTTCCAGGCCTATCCAGCCGGCACCCACCACTGCGAGGG
AAGACCCCTGCACCAGAACGGAGTTCAATGCCACGGCGTCGTTGTAGCTGCGCAGGTAGTGGACGCCGGCGGCATCGGAT
CCAGGTATTGGTGGGCGCCGTGGGGCCGATCCCGTGGCCAACAGCAGCTTGTCGTAGCGCACCGCAGCGCCGTCGGGAAG
CTCTACCGTGTGTGCGGACCGATCCAATGACGACACCCGCACGCCGAGCCGCACATCCACGTCATGGTCGCGGTACCAAT
CGGAGGTCTGGATGGTGAAGTCGCTCAGCGACTTTTTGCCGGCCAGAAACTCCTTGGAAAGCGGCGGCCGGTCGTAGGGC
AGGTGCTCTTCGTCGCCGAACAAGATAATCCGACCGCCGAAGTCGCTGCGGCGCAACGCCTCTACGGCTTTAGCCCCGGC
AAGTCCCCCGCCAACAATGACGAACGTGGTTGAGCTGGCCATAATTGCTGCTCCGTCCTGTTGTGTGCGGTGCCGCTTGA
CAGCCTACGAGCCGGTCGCGTACCTGGGTCAACCGGTCACCTGCAGGCGCAGCTCGTCGTCTTACGCCACTCGCACTAAC
GCAGCAGCGAGCAGCGCATTGGAGCTGGGTGCCACCGACGCCAGCTTCTTCGGGTCAGTGGGCAAGCCGAGCTGCTTCGC
CGCGGCGGTGGCTCGATCGTCGAAATACGGTCGTACCCAGATCCAGACGTCTTGGACCTCGCGTAAGAAAATGTCGGCAC
CGGTGTCGCCGATTCCGTTGAAAGTCTTGAGCATACGTTTGGCGGCCGAAACGTCGGGTCGTGTGCGCTGGGCGAGTTCC
CGCAAATCACCGGAGTACTCGTCGCGAACCCGGTGAGCGATAGCGGTGAGCCGGGTGGCTGAGCTCTCGTCATACCGCAC
GTAGTGGGCACGGCCAAACGCACTGATCATCGTTTGTCGCTCTGCTGACAGCACAGCTTTGGGTGTCCGCAGGCCCGAGC
AGAACAATTCCCGGGCGGCACGTGCTGCCGTGGCGGCACCGATCGGCTTGCTGGCCAGCATGCACAGCACCAGCAGCTGA
AACAGCGGCATCGGTTTGTCCCTGATCCGGATTCCCGCCTCCGCCGCGTAAGTGGTGCCGGCGAGTTTAAGCAGTCGTCG
TGCCAGTGGCTCCGGCTTGATCACAAGCAACCGCATACCCGCAATGCGTGGCGGCAAACCGCGACTATTGCTCGGGCAAG
CGCGCTCCGGCGGCCTAAGCCCCGGTTCCGGCCAACCCCTGTCAGTCCAAATCCACCCGGATGGTCAGCAAGTCGGTGCC
CATCGCGCGTACGCCGGCACTGTTCAGCCGGGGTAGGCCGCGCAGCCGCTGCCTCGGATCGTCGTCGGGTAGCAGGTAGG
CGGTCCCACTGCGCCATCGGCCGCCGATGCGGACCCGCACGGCGGGGTTGGCCTTGATGTTGTAGACGTAATCGGAATGC
TCGCCGTGCTCGGACACCATCCAGAACTGGTTGTCTACGACGCGCCCGCCACCGCGGTACGCCGCGGCTGTCCCGTTTT
GCGGCCGATGGTTTCGAGCATGGTCATCGGCAGTTGCCGGCCGATTGGATTGACCACGAACCGTTGCACGCGATGGACGA
ATTCCCGCTTGAGATTCATAGCTGCATTCAACGCTACCGATCTGGCCGCGGCCTCACGTTGGTGCCCCGATAGGGCCGAG
CCGCCGCAGTTGTGTCACGTGCCGAGGTGACAGCTCCTCAAGGCAGGTCACGCCCAGTAGCCGCATGGTCCGGATCACAC
CTGTCTGAAGGATCTCGATCGCGCGGTTGACGCCCGCCTCACCACCGGCCATCAGCCCGTAAAGGTAGGCCCGCCCGATC
AGCGTGCACCGTGCCCCCAACGCGATCGCCGCGACGATATCGGCGCCCGACATGATGCCGGTGTCCACCAGGATTTCGGT
GTGTTTGCCCAGTTCGCGTGCCACGTGGGGCAACAGGTGGAAGGGTACCGGGGCTCGGTCAAGCTGGCGGCCGCCGTGAT
TGGACAACACGATGCCGTCGACGCCGCGGTCCACCACGGCGCGGGCGTCGTCGAGTGTTTGGATCCCTTTGACAACGAGC
TTGCCCGGCCACTGCGACTTGATCCAGGCCAAATCGTCGAAGGTGAGGCTGGGGTCGAACACGGTGTTCAAGTACTCGCC
GACGGTGCCAGGCCAGCGATCCAGTGAAGCGAAGGCCAGCGGTTCGGTGGTCAACAAGTCGAACCACCACCGCGGGTGTC
CCATCGCGTCGAGAACGGTTCGCAGCGTCAGCGCCGGCGGGATGGACATCCCGTTGCGGACATCGCGTAGCCGGGCACCG
GCGACCGGGACGTCGACCGTGACCAGCATGGTGTCAAATCCCGCGGCGGCGACGCGCCGCACCAATGCCATCGAGCGGTC
TCGATCACGCCACATATACAGCTGGAACCATTTGCGGCCCTGCGGCACAGCGATGACGAGGTCTTCGATGGCACAGGTGG
CCAGGGTGGATAGCGAAAACGGGATCCCAGCCGCGGCCGCCGCCCGCGCGCCGGCGATCTCGCCCTCGGTGTGCATCAAG
CGGGTGAACCCGGTTGGCGCGATCCCGAATGGCAAGACGGTGGGCTGACCGAGGACGTTCAGCCGGCGCACACGGTGGT
GACGTCACGCAGGATTGTCGGGTGAAACTCGATGTCGCGGAACCCTTGTCGAGCACGCGCGATGGACAGTTCGTCCTCGG
CACCCCCGTCGGCGTAGTCGAACGCCGCCCTAGGGGTACGCCGTTTGGCAATGCGTCGCAGGTCCTGGATGGTCAGCGCG
GCGCCCAGGCGGCGCTTGGAGGTGTCGAACTGCGGCCTGTTGAACTGGAGCAGGGGTGCCAGATCGCGCACTCTGGGCAC
TCGCCGGTTGACCGCCATCCGTTTATCTAACCAGTTTGATATGAAGTCAGCAAGCGACCCGTTCGACCTGAAGCGTTTCG
TGTACGCGCAGGCTCCGGTCTACCGCAGCGTCGTCGAGGAGCTGCGCGCCGGACGAAAGCGCGGTCATTGGATGTGGTTC
GTCTTCCCACAACTCCGCGGGCTAGGTAGTAGCCCACTGGCAGTGCGCTACGGCATCTCCTCGCTCGAGGAAGCCCAGGC
CTATCTGCAGCATGACCTGCTCGGGCCCCGCTTGCATGAGTGCACCGGGTTGGTCAACCAGGTGCAAGGCCGCTCAATCG
AGGAAATCTTCGGCCCGCCCGACGACCTCAAGCTGTGCTCGTCGATGACCCTGTTCGCCCGTGCCACCGACGCCAACCAG
GACTTTGTCGCGCTGCTCGCCAAGTATTACGGCGGCGGAGAGGACCGGCGGACGGTGGCATTACTGGCGGTCACATAGAC
CGCGCGATCCACCGGGGCGTCGACGCCTGACAGCGGATGTAGGTTCGGGCTCATGGAGAAGGTGATCGCCGTGCTCATGC
GGCCCGAGCCAGACGACGACTGGTGTGCCCGCCAACGAGCTCAAGTCGCCGACGCCCTGCTGGGACTGGGCGTTGCTGGG
CTGTCGATCAATGTCCGGGACAGTACCGTGCGCGACTCACTGATGACCCTGACAACGCTGTACCCACCGGTCGCAGCGGT
GGTCAGCCTGTGGACCCAGCAGTGCTATGGCGAGCAGGTAGCAGCCGCCCTCAGGCTACTGGCTCAGGAGTGTGATGAAC
TCGGCGCATACCTGGTGACCGAGTCGGTTCCGCTGACCTTCCCATCGCTCGTCGAGTCCGGTTCTCGTACACCGGGTCTG
GCCAACATCGCGTCCTGCGCCGGCCCGATGGCCTGGACCAGGCGACCTGGCTGACCCGCTGGCAGCGCGACCACACGCA
AGTGGCTATCGAGGCACAGGCGACATTCGGCTACACCCAGAACTGGGTGGTACGAGCCCTCACCCCAGAGGCACCGGGAA
TCGCGGGCATTGTCGAAGAGTTTGTTTCCCGTGGCGGCGACAACCGATCTGAAAGCCTTCTTCGGAGCCGCCGACGACAAC
GATCTGCGGAATCGGATAAGCCGGATGGTCGCGAGCACATCTGCATTCGGTGCCAACCAGAACATCGACACCGTGCCAAC
CAGCCGCTACGTGTTCAGAACACCGTTCAAGGATTGAGGAACGTGAGATGACAACACTCAACGAAGCCGCGGCACTGGCG
GCGGCAGAACGTGGGCTTGCGGTGGTTTCCACCGTTCGTGCCGACGGCACCGTGCAGGCGTCGCTGGTCAACGTTGGACT
GTTGCCGCATCCTGTCAGCGGCGAACCATCTCTGGGATTCACCACCTATGGCAAGGTCAAACTCGGCAACCTTAGGGCGC
```

FIGURE 4(continued)

```
GCCCACAACTGGCCGTCACGTTCCGCAACGGTTGGCAGTGGGCGACCGTCGAAGGCCGAGCACAACTTGTCGGCCCCGAC
GATCCGCGGCCGTGGCTGGTCGACGGCGAGCGATTGCGGCTGCTACTCCGCGAGGTCTTCACTGCGGCGGGTGGCACGCA
CGACGACTGGGACGAGTACGACCGGGTGATGGCGCAGGAGCAGCGCGCCGTGGTGCTGATCACGCCCACCCGCATCTACA
GCAACGGCTGAGGGACTCAGCAAACGGCGTCGCTCGTGCGACCTGCGGGGTCGAGTTGGGTTGGGTTGAGTCGGGCGGCT
GCGATGATAGCTCGCAGTGTGCGCCGGCAGCGTCCGCAGTCGCCGCCAGCCCCGCACACAGCGGCCACTTCTTTGGAGGT
CGACGCACCTCGCGCCACGGCGTCACACACGGTTTGGTTGGTGACGCCGACGCACAAGCACACGTACATCAGCAAACCCC
CAGCAGATGCTGCGTCGGCGAACGATCAAGCCGCATATTAGTGGAGTCTAGCCTAAGCTGATTAGTGGAGTCTAACCTAA
CAATGACCCGCGGCTTGGACTTTGCGCCGGCGAGACGCGCCGACGCCGCAACAAACCCTGCGCCGACCCGTACTCGCTGC
ACTAGATTGAGACGCGGCACGCAAACGTGCTGTTATCAGCCCAAGACGAGCCCGACACCGGTGCGCTCCAGCCCTGCCCA
CCTGGCGCGGTTCGCCACGACAGCCTTATATCCCATAGGAGTGGTCATGCAAGGTGATCCCGATGTTCTGCGCCTGCTCA
ACGAACAATTGACCAGCGAGCTCACCGCTATCAACCAATACTTTCTGCACTCCAAGATGCAGGACAACTGGGGTTTTACC
GAGCTGGCGGCCCACACCCGCGCGGAGTCGTTCGACGAAATGCGGCACGCCGAGGAAATCACCGATCGCATCTTGTTGCT
GGATGGTTTGCCGAACTACCAGCGCATCGGTTCGTTGCGTATCGGCCAGACGCTCCGCGAGCAATTTGAGGCCGATCTGG
CGATCGAATACGACGTGTTGAATCGTCTCAAGCCAGGAATCGTCATGTGCCGGGAGAAACAGGACACCACCAGCGCCGTA
CTGCTGGAGAAAATCGTTGCCGACGAGGAAGAACACATCGACTACTTGGAAACGCAGCTGGAGCTGATGGACAAGCTAGG
AGAGGAGCTTTACTCGGCGCAGTGCGTCTCTCGCCCACCGACCTGATGCCCGCTTGAGGATTCTCCGATACCACTCCGGG
CGCCGCTGACAAGCTCTAGCATCGACTCGAACAGCGATGGGAGGCGGATATGGCGGGCCCCACAGCACCGACCACTGCC
CCCACCGCAATCCGAGCCGGTGGCCCGCTGCTCAGTCCGGTGCGACGCAACATTATTTTCACCGCACTTGTGTTCGGGGT
GCTGGTCGCTGCGACCGGCCAAACCATCGTTGTGCCCGCATTGCCGACGATCGTCGCCGAGCTGGGCAGCACCGTTGACC
AGTCGTGGGCGGTCACCGACCTATCTGCTGGGGGGAACTGTCGTGGTTGTGGTGGCTGGCAAGCTCGGTGATCTGCTCGGC
CGCAACAGGGTGCTGCTAGGCTCCGTCGTGGTCTTCGTCGTTGGCTCTGTGCTGTGCGGGTTATCGCAGACGATGACCAT
GCTGGCGATCTCTCGCGCACTGCAGGGCGTCGGTGCCGGTGCGATTTCCGTCACCGCCTACGCGCTGGCCGCTGAGGTGG
TCCCACTGCGGGACCGTGGCCGCTACCAGGGCGTCTTAGGTGCGGTGTTCGGTGTCAACACGGTCACCGGTCCGCTGCTG
GGGGGCTGGCTCACCGACTATCTGAGCTGGCGGTGGGCGTTTTGGATCAACGTGCCGGTTTCGATCGCGGTGCTGACAGT
GGCGGCAACCGCCGTCCCTGCGTTGGCCCGACCGCCCAAACCGGTCATCGACTACCTTGGGATCCTGGTCATCGCTGTGG
CCACGACCGCTTTGATCATGGCCACAAGTTGGGGCGGAACCACCTACGCCTGGGGCTCAGCGACCATTGTCGGGCTGTTG
ATCGGGGCCGCAGTGGCGCTGGGTTTCTTCGTGTGGCTGGAGGGCCGCGCCGCTGCGGCCATCCTGCCGCCCCAGGCTGTT
TGGCAGCCCAGTATTTGCCGTGTGCTGCGTCCTGTCCTTCGTGGTCGGATTCGCGATGCTGGGTGCACTGACCTTCGTAC
CGATCTATCTGGGGTACGTGGACGGCGCGTCGGCGACCGCGTCAGGTCTGCGCACGTTGCCGATGGTGATCGGCCTGCTG
ATCGCCTCGACCGGGACGGGTGTCCTGGTCGGCCGGACGGGCCGCTACAAGATCTTCCCGGTCGCGGGGATGGCGCTGAT
GGCGGTTGCGTTCCTGCTGATGTCGCAGATGGACGAGTGGACGCCACCGCTGCTGCAATCGCTGTACCTGGTCGTCCTAG
GTGCCGGCATCGGATTGTCCATGCAGGTGCTCGTTCTCATCGTGCAGAACACGTCGTCTTTCGAAGACCTCGGCGTCGCA
ACATCGGGTGTGACCTTCTTCCGGGTGGTCGGCGCCTCGTTTGGTACCGCAACATTCGGTGCGTTGTTCGTAAACTTCCT
GGACCGAAGACTCGGTTCCGCCTGACGTCGGGCGCCGTCTGTCCCGGCAGTGCCATCTCCGGCTGTCTTGCATCAGC
TGCCCCAGAGCATGGCCGCCCCGATCGTGCGGGCATATGCCGAGTCGCTCACCCAGGTGTTCCTTTGCGCGGTCTCGGTC
ACGGTGGTCGGTTTCATCCTGGCGCTGTTGCTGCGAGAGGTACCGCTCACCGACATCCACGATGACGCCGACGACCTCGG
CGACGGGTTCGGTGTGCCCAGAGCCGAATCGCCGGAGGATGTGTTGGAAATCGCGGTTCGGCGTATGCTGCCGAACGGGG
TGCGACTGCGCGATATTGCGACACAACCCGGTTGCGGACTCGGCGTCGCCGAGCTGTGGGCCCTTCTGCGGATCTATCAA
TACCAGCGGCTGTTCGAGGCAGTACGGCTGACCGATATCGGTAGACACCTGCACGTGCCCTATCAGGTCTTTGAACCCGT
CTTCGACCGTCTGGTCCAGACCGGCTACGCGGCACGCGACGGCGACATCTTGACGCTAACCCCGTCCGGGCACCGTCAGG
TCGACTCCCTCGCAGTTTTGATCCGTCAGTGGCTGCTCGGACCACTTGGCCGTGGCGCCCGCCTTGAAGCGACAGCCAGAC
CACCAATTCGAAGCCGCTCTGCAGCACGTCACCGACGCGGTGCTCGTTCAACGAGACTGGTATGAAGATCTGGGCGACCT
GTCGGAATCACGCCAACTCGCGGCTACAACGTAGCGATGCTTGCCGCGCGTAGCCGCGCGAGCTGATCCGCGCTGCAGAA
TGACTGCCATGACAGCCACACCGCTTGCCGCGGCCGCGATCGCCCAATTGGAGGCAGAGGGCGTCGACACCGTCATCGGC
ACCGTCGTGAACCCCGCCGGACTCACCCAGGCCAAGACCGTGCCGATACGCCGGACCAACACATTCGCCAATCCTGGCCT
CGGCGCCAGTCCGGTGTGGCATACCTTCTGTATCGACCAATGCAGTATTGCATTCACCGCAGACATCAGTGTGGTCGGCG
ATCAACGTCTCCGCATCGATCTGTCCGCCTTGCGCATCATCGGCGACGGGTTGGCGTGGGCGCCCGCCGGGTTCTTCGAG
CAGGACGGCACACCGGTCCCCGCCTGCAGCCGGAGGAACACTGAGCCGGATCGAGGCCGCGCTTGCTGATGCCGGCATCGA
CGCGGTAATCGGCCACGAAGTCGAATTCCTCTTGGTCGACGCGGACGGCCAGCGGCTGCCTTCGACGCTGTGGGCGCAGT
ACGGTGTCGCCGGGGTGCTCGAGCACGAGGCGTTCGTCCGCGATGTCAACGCCGCGGCAACGGCAGCAGGCATCGCTATC
GAGCAGTTCCATCCCGAATACGGTGCCAACCAATTCGAGATCTCGTTAGCGCCGCAGCCGCCGGTCGCGGCCGCCGATCA
GCTGGTGCTGACCCGCCTCATCATCGGCCGTACCGCCCGCCGGCACGGGTTACGCGTGAGCCTATCGCCAGCGCCCTTCG
CCGGAAGTATCGGATCCGGTGCCCACCAACACTTCTCGCTGACTATGTCGGAAGGGATGCTGTTCTCCGGTGGGACTGGA
GCAGCTGGCATGACCTCGGCCGGGGAGGCCGCGGTGGCAGGAGTGCTTCGCGGACTACCGGACGCCCAAGGCATCCTGTG
CGGATCGATCGTGTCCGGTCTGCGAATGCGACCCGGTAACTGGGCCGGAATCTATGCATGCTGGGGTACCGAAAACCGGG
AAGCGGCGGTGCGATTCGTCAAGGGCGGGGCTGGCAGCGCGTACGGCGGGAACGTGGAGGTGAAGGTCGTCGACCCGTCG
```

FIGURE 4(continued)

```
GCCAACCCGTATCTCGCGTCGGCGGCGATCCTCGGACTGGCACTCGACGGCATGAAGACCAAGGCGGTGTTGCCGTCGGA
AACGACCGTAGACCCGACACAGCTGTCTGACGTGGATCGTGACCGTGCCGGCATTCTGCGACTTGCTGCCGATCAGGCGG
ATGCAATTGCTGTACTGGATAGTTCGAAACTGCTTCGGTGCATCCTTGGCGATCCCGTGGTAGATGCCGTGGTCGCGGTA
CGCCAGTTAGAGCATGAGCGCTACGGTGACCTCGATCCTGCGCAGCTGGCCGACAAGTTCCGGATGGCTTGGAGTGTGTA
ACGATGGCCGACTCCGCCGGTTCGGACCTGACGCGGCACACGGCCGAAGTGCCGTTGATCGATCAGCACGTCCACGGATG
CTGGCTGACCGAGGGGAACCGGCGGCGGTTCGAGAACGCGCTCAATGAGGCCAACACCGAACCCCTGGCAGACTTCGACT
CGGGATTCGACTCACAACTCGGGTTCGCCGTGCGCAACCACTGCGCTCCCATCCTTGGATTGCCTAGGCACGTTGATCCG
CAGACTTATTGGGATCGCCGCAGTCAATTCAGTGAAGCTGAATTGGCTCGCAGATTTCTGCAGGCCGCCGGGGTAACCGA
CTGGCTGGTGGAGACCGGAATCGGCTACGACGTGTCCGGAATGGCAAGCGTCGCCGGCCTCGGCGAACTGTCGGGCAGCC
ACGCTCACGAGGTGGTTCGTCTTGAACAGGTGGCCGAACAGGCCGTGCAGGCATCCGGCGACTACGCCTCGGCGTTCAAC
GAGATACTGCGCCGGCGCGCAGCCACAGCGGTGGCAACCAAGTCCATCCTGGCCTATCGAGGTGGATTCGACGGTGATCT
GACCGAGCCACCCGCGGCGCAGGTCGCCGAGGCCGCCAAGCGCTGGCGCGACCGTGGCGGTGTCCGATTACAGGATCGGG
TTCTGCTGCGCTTCGGGTTGCATCAGGCGTTGCGCCTGGGCAAGCCGCTGCAGTTCCACGTCGGATTTGGCGACCGGGAC
GCTGATCTGCACAAGGCCAATCCGCTGTATCTGCTCGACTTCCTGCGGCAGTCCGGCAATACCCCAATCGTGTTGCTGCA
CTGCTATCCCTACGAACGAGAAGCCGGTTATCTGGCACAAGCCTTCAACAACGTCTATCTTGACGGCGGGTTGAGTGTGC
ACTACCTGGGGGCCCGGTCGCCGGCCTTCATCGGCCGACTACTGGAGCTTGCCCCCTTCCGCAAGATCGTGTACTCGTCG
GACGGATTCGGCCCCGCGGAACTGCACTTTCTCGGTGCAACGTTGTGGCGCAGTGGAATTCAGCGTGTTCTGCGTGGCTT
TGTCGAGCGCGACGACTGGTGCGAGACCGATGCCCTGCGGGTGGTCGACCTAATTGCCCATGGCACTGCCGCACGCATCT
ATCGCCTTGGCGATCGGTAGCTTTCAGGTGGCGCAAGTGTGGCCCCGTCACGGGCTAACCATGGACCGTGCCGGACCCAG
TGTCACCGGCAGCGTCGACCAACCGCGCAGCACCCGCGTGTCACGCCGACTTCCGGCACCCGCGGCCCGCACATCGGGGA
AGCGGTCGAAGAACGTTCTCAGCCCGACCTCGCCTTCGGCGCGGGCCAGGGCGGCCCCCAGGCAGAAGTGGCGGCCGGTA
GAGAACGCAAGATGTCGTCCGGCATTGGGGCGTTCGATGTCAAAGCGGTGCGGATCCGGGAACACAGCGGGATCGCGGTT
GGCGGCTGCTAGGTAGATCACCACGACTTCGCCGCGTTTGATTCGCACACCAGCCACCTCGACGTCACGGCAAGCCACCC
GGGCGGTGAGCTGAACCGGCGAATCCAGCCGCAGGATTTCTTCAACCGTATTCGGCCACAGCTCCGGATGTTGGCGCAGT
GTGGCCAGATGTTCGGGGGTATCCAACAACATGCGAATCCCGTTGCCTAACAGGTTCACTGTGGTTTCGAATCCGGCGAC
CAAAACCAGTCCGGCGATCGCCCGAAGTTCGGTCTCGTCGAGCTGTGTCTCGTTTGTCCCCGCTTTCGGCGATCTGGATCA
ACTGACTCATCAGGTCGTCACCCGGAGCGTGCCGCAACTGCTGCAGATGCCCTTCCAGCCAGCAGTCGAATCCTCGTATC
CCCTGCTGCACACGCAGGTACTGCCGCCACGGAATCCCGATGTCTAGACTCGGCGCTGCCAACTCACCAAATTCCAGGAC
GCGCGGCCTGTCATGCTCGGGCACGCCCAAAATTTCGCTGATGACCACGATCGGCAGTTGCGAGCAATAGCGTCCTACGA
CGTCCACAATCCCGGGCTGCTCAGCGAACCGATCCAAGAGATTGATCGCGGTCTGTTCGACCAGATCGCGTAGCGCGCTG
ACCGCCCGTGAGGTGAACACCGCCGACACCGTTTTGCGGTAGCGAGTGTGATCGGGCGGCTCGACGGCCAGCAGCGAAGG
TTCTCGCAGGGGGTGAAGTTGATCGCCGCGGGTCCGCCGCTCCAGCCAGCGCAGCGGTGGTGGCAGATTCTCGCCGAAGG
AGACGACGCGGAAGTCGTCCGATCGCAGCAGTCATGGCGCAACTCGATGGTCGACGGTCAGGTAGTTGGCGCGGTTGCGC
ACCAGGGCGCCGTGGGACCGGACTTCGTCGTAAAAGGGCACCGGATCGGTGGCGACGGCCGGATCCGCGATCAGCCGGGC
CTGCAAGTCGCCACGCCGAATCCCGATTGCCGCAATGCCGCGGATCACCCCGTGCATCGCCAACCAGTGCAGCTTGTCCT
TCACCGCGCCTCCGTCGATCGAGTGGCTTTTCTTCAAGACTAGAACCCGCAATTCAACATTCGGCGAGGATGTTGAAGTC
TGTTGACACCACCGTGTTGGGTTTTTTGCTGCTGATGCCGTAGGCACTGCCGGCAACTGTGTATGTGTTGCGGGCGCGGT
CGGCGCGGGCGTTGCCCACCCCGCCGTGCCAGAAGCTGCCGTTGAACCCGTCGACGTTACGGATCTTCACCCACTGCGGG
ATTACCCTGTCACCGCTGAGCAATACCACGGCTTGGACGGTGCTGTCGTGGTTGCGGATGTCGATGGTCCGGTAGGAGTG
CTCCTGGCTGCATGTTGCGGGACGTGTCGTGTGAGTGACGCCGTCAATAGTCAGGCGTGCGGCTTTTCGGGGTACCGTCT
GAGCTTGCCCGCACGCGGAGAGACCAGCCGCGACGACCATTGCAACTCCGGTCACTGTGACCAACCGATTGCACACCAGC
CACCTCCATTCGGGCCTGAGCATTGTGCTCGGGACATTACTTCCGTTTTGGCTCCAACGTGGCCAGGGACTTGGCAATGT
GACGTCGGACGAACTCCGGACTGACGCCCTTGAGCCGATCAATCCAGCGAATGCTTCGGGGCACATACCAATGCAACCGT
GTGGGGTGCTGGTAGGCCCGCCAGGCTGCCTCGGCGACGCTGGACGAGGGCATCAGCCGGAACATGCCCTTCTTGGGCGC
GGCAGCGCGGATCTGCTCCGCGGAGATCGTGTAGGGGCCCTCGTCGGAATGCTGGCGCGTCGAGGTGAGGATAGCGGTGT
CGATCAGACCGGGCAGCACGTCGGCGACGCGAACCCCATGACGCTGCCACTCAACGCTCAACGCCTCGGTCAACCCCTTG
ACGGCGTGTTTGGTCGCCGAGTAGACCGCGATACGCGGCATGCCATAGGTGCCCGAGGACGACGACGTCGAGAACATCAG
ACTTCCCGGTGCTTTCTTGAGGTAAGGCAGTGCGGCGTAGGCGCCAGTGAGCACCGCCTTGAAGTTCACGTCGACGACGC
GCACGGCGGCCTCGTACGGCACGTCCTCGAACCAACCGCCTTCGCCGATGCCGGCGTTGTTCCACATCATGTCGAGACCG
CCGCCGACATTGCCGGCGCAGAAATCAGCGAGCGCACCCTCAAGGGCCGCCTTGTCCGTAACGTCGACGGCGCGGGCCCA
CAGCCGTTCGGCACCAAGCTGTACGCGCAGGGCAGCCAGCCCATCCTCATTGCGGTCTATCGCACCTACTCGCCAGCCGT
TGGCGTGGAAAAGCGTTGCACCCTCGCGGCCCATTCCACTGCCGGCGCCGGTGATGAATATCGCTTTCATGCGGAATCCG
GAATAGCCGAACCGCCCTCAGCCTGCTTCAACCAGATCTTTGATGCGCTGCAACGTCTTGGTCATGTCTCGGATGTTGCG
GCGCTGACGCAGCCAGCCCCCGAACACCCGGTAGTACACGGTGGTCAACACGGACGGGGGGAGCCGAAACGACTCAGTGA
CCTCGGTGCCGTCGGCGGTGGGCGTCAAACGATAATGCCAATTGTTCACCGGTCTGTCGCCGAGCAGCACAGCAAACCCG
AACTCACGGCCCGGTTCGCATACCGTCCAGTAGACCGGCCCGATCCCGTTGCGCCGGACATGCCCGCGGAATCGAGCGCC
```

FIGURE 4(continued)

```
AAGCGCGGGGCCGGTGGCACCGTCAAGCCACTCGGCCTCGAAGGTTTCCGGCGAGAACCGGCCGGTATTGCGGACATCCG
CGATCAATGTCCAGATCTTGTCCGGCGGCGCTGCCATGTGAACTGTGGCCGAACCTTCCATGACCTGATCCAAACACATA
CGTCGACCTGGTCATAGACCGCACACGCCGCCAACCGTCAGCGCGGAATACTTGCCTGAATGCCTGCCCAAATGATCTCG
TTGATGATTTGCTTGATGCCCTGCGCGGGTTTCGACCACAGTGCGATCGGAAGGCCAGAGGCGGCGCCGCACGTCGGCCA
CGCGTCCAATCCCTGTTCGGCGAGAACCCGATTGGCAACTGCGATTTGTTGTTCCCGAGAGGCAGCTGCTGGGTTGCCGA
CACCGCCGAATGCGGCCCAGGTGGCCGGCTTGAACTGCAGTCCGCCGTATTTGCCGTTTCCGGTGTTGGCCGCCCAGTTG
CCCCCGGATTCGCACTGCGCGACGGCGTCCCAGTTCGGGCTGGGACCGGCGTGGGCAACGGCGGTGGAGAGCGACATGGA
TGCCGTGACGAGTCCTGCGGCCATGGCGGACTTGATGAGCGGCTTGGCGATTCTTGTCATGCTCGACATATCGCCGGAAG
TGGCCGAAGCGTTACCGATTAGAGAGAGTGGTGAGATCGGGTGTCTATTGCACCGCGACCGGCCGTGGTCGGCCGGCAAA
GGATGCACAACCGGATTGATCAGGCCGGCGGTAGGGCCTGGCAATACGACTGTGTTGCTGTCGTCAGGGCCCGTTGATAG
AGGCTATCGAGGTGGCGGGACCGCACTATGTCGCGTTTGCGCGCGGTCGAGTTGGGCGGCGCAGGACGGCGCGGACAGCAA
ACTCCAGTGACTCCAAATCTGCGACAGCATCCGATTATTCAGGGAGTCGATCGCCGATCGCGATGCCGATAGATCCGGCG
GCTCCGGGGGCGCGCTGGCCGGGTTGAGCTTCCAGTCCGAGAACCGGCTGTACTCGATTGCCTCGGTGGCGCGAATCTGG
TCGTCGAAGACGCGGGTGACGTAGTCGGGGTCGATGTGCTGCGAGCGGGCATCTTCGCCCAACTTTGCGAGTTGCTGTTC
GACTCGGCCGGAATCCTCAATGGGCAGCTGAGCACGCCACTTGAAGGCTGCCACCGGGTCGGCGACCTCCAACCGCTCAG
CGGCGGCGTCGACCAACTCGGCTAACTGGCTGGTGCCGTCGGCTCGCGCCAGCGGGGGGCCTAGTGGTGCAATCAGCGAC
AACAGGATGCCGATCGAGACGGCGGTCGCGAGGTATATCTCACGTGGACGGGTAAGCAACCCTTCGGTTGATCCCGTCAG
CCGGCGCCTAACGAACTCTGCAGGTCACCCTTCATGGCGTTGAGCTGAGCGCCCAGTACTCCCAGCTGTGCGTGCCGTT
GGGCGGGAAGTTGAACACGGCGTTGTGCCCGCCCGCGGCGTTGTACGCATCCTGGAACTTCAGGTTGCTGCTACGAACGA
AGTTCTCCAAGAACTCGGCGGGTATGTTGGCACCGCCCAACTCGTTCGGGGTGCCGTTCCCGCAATAAACCCATAGCCGG
GTGTTGTTTGCGACCAGCTTGGGGATCTGCTGCGTAGGGTCGTTGCGCTCCCATGCCGGGTCACTCGAGGGACCCCACAT
GTCTGCGGCCTTGTAACCGCCGGCGTCACCCATCGCGAGGCCGATCAGGCTAGGCCCCATCCCCTGAGAGGGGTCCAGCA
GGGCCGACAGCGAGCCGGCGTAGATGAACTGCTGGGGGTGGTAGGCGGCCAAGATCATTGCCGACGAGCCGGCCATCGAC
AAGCCGATTGCAGCGCTGCCGGTGGGCTTCACGGCCCTGTTGGCGGACAACCATTGCGGCAGCTCGCTGGTCAGGAAGGT
TTCCCACTTGTAAGTCTGGCAGCCAGCCTTACCGCAGGCCGGGCTGTACCAGTCGCTGTAGAAGCTGGACTGCCCGCCGA
CCGGCATGACTATCGACAGTCCCGACTGGTAGTACCACTCGAACGCCGGGGTGTTGATATCCCAGCCGTTGTAGTCGTCT
TGGGCGCGCAGGCCGTCGAGCAGATAAACCGCAGGTGAGTTGTTCCCACCGCTCTGGAACTGAACCTTGATGTCGCGGCC
CATCGACGGCGACGGCACCTGCAGGTACTCGACCGGCAGCCCCGGCCGGGAGAACGCGCCCGCGGTTGCCGCTCCGCCGG
CAAGCCCCACCAGGCCCGGAAGGACTACAGCCGCTGCCGTGCCGATCATCAATCGGCGTCCCCAAGCTCGAATCTTTCGG
CTCACGTCTGTCATACTTGTGCCCCTTTGTCCTGTATGTCGTGTGCTCGGGCCAGAACATACCGTGTGTGGAGGCCA
AATGTCGATTCGGGCGCAAAGTCGTCTCATTTCCGTATCGGTTACCGCCGCGGACAGAGCAAGTGTGCTTAGGGGGCTCA
CAAACGGTATGGCGGTATGGATCTATCGCGGATTTCTCAGAATCGCGGCCCGGGGCTACCGGCTGTGCTCCCCCAGGGAG
GCCGAACTTGCGTTCACCGCGTAGGCTCGCTCGAAGCAAGCCGACGAAGACCACGCTATCCCGGTCTGTTCCGGCGTCCG
CGTAACACCGCACTGGGGTTTGTGGCGTGCGATGGTGCGGGCTGAGGGCATCGGAGGTTCCGGGAACGATTGAGGTGCGA
GAATTTGGACACGGTACTTGGGCTCTCGATAACGCCTACCACCCTGGGGTGGGTCCTCGCTGAAGGACACGGCGCAGACG
GCGCCATCTTGGACCGCAACGAATTGGAGCTACATAGCGGTCGTAACGCGCAGGCCATACATACCGCAGAGCAGCTGGCG
GCGGAAGTTCTGCTCGCCCATGAAGTGGCCGCTGCAGGCGATCATCGGTTGCCGTCATCGGAGTGACCTGGAACGCCGA
AGCTTCGGCTCAGGCGGCGCTGCTGGTAGAGTCGCTGACCGGTGCAGGTTTCGACAATGTGGTGCCGGTTCGCGGCTAC
GTGCCATCGAGACACTGGCGCAGGCTATCGCACCCGTTATCGGCTACGAGCAAATCGCGGTATGCGTTCTTGAGCATGAG
TCGGCGACCGTCGTCATGGTCGACACCCACGACGGAAAGACGCAGATCGCCGTCAAGCATGTGTGCCGCGGATTATCAGG
ACTGACCTCCTGGCTGACCGGCATGTTTGGTCGCGATGCCTGGCGCCCGGCCGGCGTGGTCGTGGTCGGCTCGGATAGCG
AGGTCAGCGAATTCTCGTGGCAGCTCGAAAGGGTCCTGCCGGTGCCGGTCTTTGCGCAAACGATGGCGCAGGTTACGGTC
GCGCGGGGTGCGGCCCTGGCGGCGGCCCAGAGCACCGAGTTCACCGATGCGCAGCTAGTGGCCGACAGCGTCAGCCAACC
AACGGTCGCGCCCAGGCGATCCCGGCACTACGCCGGGGCGGCGGCGTTGGCCGCCGCGGCCGTGACCTTCGTGGCTT
CGCTGTCCCCTAGCGGTGGGCATCCAGCTGGCTCCGCACAACGATACCGGGACGGCGAAGCACGGAGCGCACAAGCCGACG
CCACGTATCGCAAAGGCCGTGGCGCCGGCGGTGCCGCCTCCGCCGACGGTCACGCCACCAGTCCCTGCTCGGGCACCCCG
GCCGGCTGCGCAGCACGAACCACCCGCTCGCGTCACCTCCGGCGAAGCGCTCACGGAGCCGAACCCGCCTGAGGAGCAAC
CGAATGCTTCTGCGCCGCAACAGGATCGGAATGACAGCCAGCCGATCACTCGAGTGCTAGAGCACATACCCGGCGCTTAC
GGTGACTCGGCACCCCCAGCTGAGTAGTCGGAGGCCGCCGTAGCCGGTTGCGAAACCTGTTCGCGCGGACCCATGTCGAG
GCGAAGCGGTGGGTACTCGTCGCGCATCAGCGTGGTGTATGCGCGGACCCGCAACGCCCACCGGTTTACAGGTTGTATAG
CCCTATGGGGTACCGGCCGGTGAACAGGAGCGCCACCACGGCGACGAGCAGCAGGATCACCAGTAGCGAAGGCCACATTA
TGCCGACGCGGTCGTGGGGGTCGATCAGGAAGACTCGCCAACCGCTGGAGAGGAAGACCGCCAGGATCAGGTAGTGCGGG
ATAGCAAGTAGCCACCACTTAATCAGCACCAGGCCGCGGCTCAACCGCTCCGGATAGTCAACCTCCAAGTCAGCCGGATA
CTCCGCCTTTGTCTGCAGGCTGAAGGGCGGGTACCGGTCGGTTCCCAGCGCCGACAGCGCATAGAAGGCAACCCGCCAGC
GCCACCGCATGACGCCGACATTGAAGTCGAACAGCGTCCGGGGATATCTGCCCGTGAACAGGATGGCAAAGAACGCGATC
ACGGTGACCACCACGGCGGCAACGTGCAAGAAGAACAAGACAATGTAGTGCGGGATGGCCAAAAACCACTTGACTAGCCA
```

FIGURE 4(continued)

```
CTGCCAACGTGACAACGCAGGATCGAGGTCACCCCGGACCCGGACTGGATAGGCGTCAGGTTGCATGATCGACGGCTCCT
TTACATGCGCGTCGGCTCGATCCACGAGCCAGGCCCATTGTCTCTCATCTGCCGCGCATGGGCGAAGCCATCGTCGTGCG
CTACGGACACCGGATCGACGTGCAGTAATAGCCTTGGGCTGTAGGCAGCTTTCCGGGCGATGACGGCGGCACTGGTAATC
CATTGTCGGCCAACAATTTACTGAGAGGGGTCGGTACAGATTGCCAGCCGTGGCTATCCAGGTACGTGGCAACGTCGTTG
CGCTCGCCGTCGCTGTATAGCAGGTTGGGTGATTTCTATGTCGAACCCGTGGACGCTCCAGCGCTGCGAAGCGGTGTCAA
GGAGGTCGGATGCCGGTCCGCCATCGTCATCTACCGACTCCCCGGCGCGCTGAGCGCGGTGATGTTGTCCAGCAAGCGAT
CCTGAGCGTCGGGCGGCAGGAATGCCAGCAGGCCCTCGGCGAGCCAGGCACTGGGTTGGTTGGGGTCAAAGCCCGCTTGG
CGCAACGGGGTCGGCCAGTCACGTCTGAGGTCGACGGGAACCACGCGAGGTCAGCTGTTGCAGTGGCATCCAGATCAGCA
AGTGTCGTCATCGGTATGCGCGCGCGTCAAGACCTGAGGCCAGGATGACAGCCTGCCGAATCCCCGCAGACGTCGCGTCA
CGGAAAAACGCATCGAAGTACCGCGTCCGGGCGGCCAACAGGTCGGCCAATCGCTGCAGTCCCCACGTGCCGTCGGGGTC
GTCGACGTCGGTCGCCTTGATGTTTCCGGCGGCCCAGCGAGTGAAGAAGTCAATCCCCACGGCTCTCACCAGTGGTTCGG
CGAACGGATCATCGATCAGCGGGTTATCGGCCCTGGTGGCCACCGCGCGGGCGGCAGCCACCATCGTCGCCGTTGCTCCG
ACGCTAGTTGCCAGGTCCCACGCGTCGTTGTTGGTGCGCGGCATCGGGATCCTTTCGGCTCGGCCAGCGATATACAGCCT
TCGAAGTCCACCGCTTGTGGGATCAATCGTCCTTTGCCCGAACCGCGGTGAATGCCACGCTCACTTCGTCGGCGACCCGT
ATTGAACCCATCAACAGCGAGTAGGGTTTGACGCCGTAGTTGGACTGGCGAACCGTGGTGTCGGCAGAGATGCGCCACGC
AGCACCAAGATCCTCTGTGTGCAAGTCGATGACGTGTTCTCGCGACTTTCCCCGGATGTGCAGTTTCCCGGTCAGGCGGT
ACCCATTCCCGGTCTGGGCAATGGCTTCCGTGGTAAAGCGAATATGGGGGAAGCGGCTGGCGTTGAGCGTTTTCAGCGCG
TTCGCCCGCACCAGAGCTTTCTCAGGCTCGGACAGCCCCTTCACGCCACCCTCACCGCGCATCACCTCGAAGGAATCCAC
CTCAGCCACAAGCTCGCCGGCGACGGGATCGGTGCCGGACCAGTTCACCAGGGCCTGCCACCGTGTCATCGCGATGGTCA
GGCGATGACCCAAGCGCGCGGCTCTGCCAACGACTCCGGTGCGAAGTACCAGCTCGCCGTCGGAAGCATCAAGAGTCCAC
ACCGCGTCGCTCACGCCACGACTGTATTCAGACGACCTGCCTGCCCGCCCCTCCCGCCGCGTCTTGTGGGCCACGACACA
ATCGTTATGCTTGGTGAGGCTCGCCGGTGCCGTTGGAGGGGTGCAACATGATTCGCGAACTGGTCACCGCTGCGATC
ACGGGTGCCGCGATCGGTGGGGCGCCAGTCGCGGGCGCAGACCCGCAGCGTTATGACGGCGATGTGCCGGGGATGAACTA
TGACGCTTCGCTGGGCGCCCCATGCTCCAGCTGGGAGCGCTTCATTTTTGGACGAGGCCCCTCCGGTCAGGCCGAAGCCT
GTCATTTTCCGCCTCCTAACCAGTTCCCGCCGGCCGAAACCGGCTACTGGGTGATCTCCTACCCGCTATACGGCGTCCAG
CAGGTCGGTGCGCCGTGTCCGAAGCCGCAGGCGGCCGCGCAGTCTCCGGATGGGTTGCCGATGCTGTGTCTGGGAGCCCG
TGGATGGCAGCCGGGATGGTTTACCGGGGCCGGGTTCTTCCCTCCGGAGCCATAACCGGTGGGCGTTTCTCATGATCATG
TGCGAAGGCCGGCCCACCGAATCACCGATCCCACGGTGGCTGCGCTTCGTGCTTACGTCTGACCGTGCCGGCTCGGCATG
GTATATCGGGGCAGGCTTCTTCTTCGCGCCAGTGCTGGCGGTGCTTTCGCCATGGCCGACCATCACCGCGGTGCTGTGGT
GGATCATCGGACTGGCGGGACTATGGCTCGGACTGCTCGGACTTCGCGATGGCAGTCGGACTGGCCCGGGTGTTGCGTTCC
GGCGCCGAAATACCGGAAGCCTACTGGCGCACGCTGGTCGACTACCGATCCGCCAACGAATAGGAGACTCCGATGAGCTT
CAATCCCAAAGATGCGGTCGACGCTGTCCGGGACATTGCGGCCAATGCCGTCGAGAAGGCCTCGGACATCGTGGAAAACG
CCGGCCACATCATCCGCGGCGACATCGCTGGCGGGGCAGCGGCATCGTCAAGGACTCCATCGACATCGCCACCCACGCG
GTCGACAGAACGAAAGAAGTGTTCACCGGCAAGACGGACGACGAAGGTTAGTCGAGACTAGTCGGCGCGCGCTTGTCGTC
CGTTGTCAAACGGACGCGGCAGCATTGAGTGCGTCCAACCGGGCGGTCGCCTCGAGGTACTCCTGCACCCAGCGTTCGAT
AACGGTAGCCGTCTTTTCCACCTTGGTGAACTGCCCAACAACCTGCCCCACCGGGTTGAACGCGACGTCGACGGTCTCGT
TCGGGTATTTATGTGTGGCTTTGACGGCCATGCCGGAGACCATGTATTGCAACGGCATACCGAGCGGCTTCGGGCTCTCC
GGTTGCTCCCAGGCCTCAGTCCAGTCGTTGCGCAGCATCCGGGCCGGCTTACCCGTGAAGGAACGACTGCGCACGGTGTC
GCCGGCTGGTCGCCTTGACGTATGCGGCCTGTTGAACCGCGGTGTTTGCGGCTTCCTCGACCATCAGCCACTGCGAACCGG
TCCATGCCCCTTGGGTCCCCAGCGCCAACGCTGCAGCGATCTGCTGACCGCTGCCGATGCCACCCGCCGCCAACACCGGA
ACCGGCGCTACCTCCTTGACGACCTGAGGCCACAACACAATGGAGCCCACCTCGCCACAGTGCCCGCCGGCCTCGCCGCC
CTGGGCGATGATGATGTCGACGCCCGCATCGGCGTGCTTGCGGGCCTGCGAGGGTGAGCCGCACAATGCGGCCACCTTGC
GACCCGAGTCGTGGATGTGCTTGATCATGTCCGCTGGGGGGGTGCCAAGCGCGTTGGCGACCATCGTCATCTTGGGGTGC
TTCAGCGCCGCGTCGACCTGTGGGGTGGCCGTCGCCTCGGTCCAACCGAGCAGCTGCAGACTGTCCTCGTCGGCGTCCTC
GACCGGGACACCATGATCGGCGAGGATCTTGCGGGCGAAGTCCAGATGCTCCTGCGGGACCATCGACCGCAGCGTCTTGG
CGAGCTCATCCGCCGACAGCTGGGAGTCCATGCCCTCGTACTTGTTCGGGATCACGATGTCGACCCCGTAGGGGTGGTCG
CCGATGTGTTCATCGATCCAGTTGAGCTCGATCTCCAGCTGCTCCGGCGTGAACCCAACTGCTCCGAGCACACCAAAACC
ACCAGCTTTGCTGACGGCGACCACCACATCGCGGCAGTGAGTGAAGGCAAAAATAGGAAACTCGATACCGAGCTCGTCGC
AAATGGCAGTGTGCATGCCTGCTCCTGGAATGCTAGCGGACGCAAATAGAACTGAAACGTGTTCTAGTTTAGTACCCGTC
TTGGTAAGGTGGCCAACAGCCCAGGTTCCGGTCGGGTTTCGGCGCGCACCCCGGCGAAGCTGACGAGGCGGTCTAAGGTC
ACCTTCACCCGCCGCATGGCCGGCCAGCAACAACGACGGCTGTCCCACCGAGCAGAAGTACTGGGCGATGGTGTGCACCGC
GGTCGGCTACCACCGCGACGACCCCGCCGCAGAACTGCTGTTACGCAACGAAGGCTTGGCAGCTGCAGTCCAAACTGGCC
ACCTACGTCTACCCGCCACAGAAACTAGTCGCCAAGGTCCGTGCGGGCGCCAAAGTGTCCGACAACCACGACCAGGCGAC
CACTCTGTTCCACCACGCGATCGATCACCCAACCGTGACCGTGCAGCAGACCTACTCCCTGATCAACCCTCAATCGGCCC
CGGGGCGATGGACCTTGATCCGCTGGGGCCCCGCCGGTAGCCTAGTGCTGCGAATTACGCTATGCCGAGTCTCGGAATTG
CCGGCCCGCCGTTCACCACGTTCAAACGCCCGAGACCGGTGCCAGGCAGGTACGCGAACCTCATGGGTCTCAATTCGTTC
```

FIGURE 4(continued)

```
TGCCACAAAGAAAGTGAGTAAGCCAGCATGCGTGCGGTAGTCATCGACGGGGCCGGCAGCGTCAGAGTCAACACCCAGCC
CGACCCGGCACTGCCCGGGCCTGACGGAGTGGTTGTCGCCGTGACCGCCGCCGGCATCTGCGGATCCGATCTGCATTTCT
ACGAAGGCGAATATCCGTTCACCGAGCCGGTGGCCCTCGGTCACGAGGCGGTAGGCACCATCGTCGAGGCCGGGCCACAG
GTGCGCACCGTCGGAGTTGGCGACCTGGTCATGGTGTCTTCAGTGGCCGGCTGCGGCGTCTGCCCGGGATGCGAAACCCA
TGATCCAGTCATGTGCTTCTCCGGCCCGATGATCTTCGGCGCCGGCGTGCTTGGCGGCGCACAGGCCGATCTGCTGGCGG
TGCCGGCCGCCGATTTCCAGGTGCTCAAGATCCCCGAAGGTATCACCACCGAGCAGGCACTGCTGCTCACGGACAACCTC
GCCACCGGTTGGCGGCAGCCCAACGAGCCGATATTTCATTCGGCTCCGCCGTGGCGGTCATCGGCCTGGGAGCCGTCGG
CCTCTGCGCGCTGCGCAGCGCCTTCATACACGGTGCCGCAACGGTTTTCGCTGTCGACCGAGTAAAGGGACGCTTGCAAC
GCGCGGCCACCTGGGGTGCTACGCCGATACCGTCACCGGCGGCCGAGACGATTCTGGCCGCGACGCGGGTCGCGGCGCA
GACTCGGTGATTGACGCCGTCGGCACCGACGCCTCGATGAGCGACGCGCTCAATGCGGTGCGCCCTGGCGGCACCGTCTC
GGTTGTCGGCGTGCACGATCTTCAGCCGTTTCCCGTGCCCGCACTGACGTGCCTGTTGCGAAGCATCACGCTGCGAATGA
CCATGGCACCGGTACAACGAACCTGGCCGGAACTGATCCCGTTGCTGCAGTCGGGCCGACTCGATGTCGATGGCATCTTC
ACTACCACCCTGCCGTTGGACGAAGCGGCCAAGGGCTATGCAACCGCGAGGGCGCGCTCGGGTGAGGAGCTAAGGTTCTG
CTTACGCCCTGACAGCCGTGATGTACTGGGAGCGCATGAAACTGTCGATCTTTACGTCCACGTCCGGCGGTGTCAGTCCG
TAGCCGACCTGCAGCTCGAGGGTGCTGCGGACGGGGTCGACGGCCCATCCATGCTCAACTAGCCACTCCACGGGATCGGT
CTTGTCGTCGTAGGTGAGCGCGGAGAAATTCACGTCACCAGACATATTGACCCCGGGTGTGCGGTTTCCAGCGCGGCGA
GCTGCTCGTGATCCAACCGGGACCCTAAGGCGCCCAAGGCAACTCGGCTGCCAGGCGCACACAACTCATCGATCCGGGCG
AACAGAGCATATTGCGCATCGCCGGTCAGGTAGGGCAGTAGTCCCTCGACCGACCAGGCGCTGGGTCGTTGCGGATCGAA
CCCGGCCGCTGTCAGCGGCGTGGGCCAGTCCGTACGCAGATCTGCTGGCACCGCCACCCGGTGAGCTTTGGGTACAGCAC
CCCGCTCACTTAGCACCCGTGCTTTGAATTCCAGGACCTTCGGCACATCGATCTCGAAAACCGTTGTCCCGGGCTGCCAG
TCAAGGCGATAAGCGCGGCAGTCCAGACCGGCGGCGACGATCACCGCCTGTCGTATGCCAGCCTCATCAGCGCAGTTGAA
GAAGTCGTCGAAAAACCGGTTTGCACGCCGTAGAGCCGAGGGAAAGCGGTGCCGTCCTCCGACGTTCTCGGGTTTGCTA
ACAGACCCTCCAGATACGGGTCGGCCGAAGCGGTGATGAAATGCTTCGCGTATTCGTCTTGGACCAGCGGTTTAGGGCCC
GTGGTGTGCAGTGCACGCCAACCCGCAACCAGTAGCGCGGTGTAGCCCACGTTGCTGACAATGTCCCAGTGGTCGTCATC
GGAACGAAGCGAGCCATACTCAGGTGTAGTCATCTCATCAGCCTTCCAGCATTACGGTCACCGGACCGTCGTTGACCAGT
TCGACCTGCATGTGGGCACCGAACACGCCGGCTTCCACGTGCGCTCCCAACTGGCGCAGCGCTGCCGCGAACGCTGCTAT
CAGGGGCTGCGCCACCGCACCTGGCGCCGCGGCGTTCCAGGACGGTCGCCGACCCTTCGCGGTGTCTGCGTAGAGGGTGA
ACTGGCTGATTACCAGGATCGGTGCGTGCATGTCGGAGGCGGATTTCTCGTCGGCGAGAACCCGCAAATTCCAGAGCTTT
TCGGCGAGACGGCGCCTTGTCGAGATCGTCGCCGTGGGTGACACCGACGAACGCGACCAGGCCCTGCCCGTCCGGCCG
GATAGCGCCGACCACCCGACCATCGACCCTCACCGCAGCCGATGAGACCCGTTGCACCAGAACCCGCACGAGCCTCGATG
CTGCCAGGCCGGCTATGCAGTCGCTGGGGCTGGGTAGGCTCATTGTGTGTCTGTGCTGGTCGCGTTTTCCGTCACCCCGC
TGGGCGTGGGGGAGGGGGTCGGCGAGATCGTCACCGAAGCGATTCGCGTGGTCCGTGATTCCGGCCTGCCGAACCAGACA
GATGCCATGTTCACCGTGATCGAAGGCGATACCTGGGCGGAAGTGATGGCCGTCGTGCAGCGCGCGGTGGAGGCCGTGGC
CGCTCGGGCACCGCGAGTCAGCGCGGTGATCAAGGTGGACTGGCGTCCCGGGGTCACCGACGCGATGACCCAGAAGGTCG
CTACCGTCGAGCGGTATCTTCTCCGGCCTGAATAGCAGCGCTAAACGCCCGCTCGGCCGCATCCCCATGGACCGCAAATA
CCACCCTTTGCAGCGACCCCGGCCGGTGCCGACGGACGGCGCCGACCATCAGCCGCCGCAGCGTCGTCGAGCGGAAAGCCG
CCCACGCCCGTGCCGAAAGCCACCAGCGCCAGCGAGCGGCAACCGAGCTCGTCGGCTTTCCGCAGGGTAGCAGCGGTGGC
TGCGGTGATGATCTCGCCCGAGGTCGGACCTCCTAGCTCCATCGTCGCCGCGTGGATCACGTAGCGCGCCGGCATGTCAC
CGGCCGTGGTCTCGACCGCTTCCCCAAGCCCAATCGGCGCCTTCTCGGTGGACTCGCGCTGCAGCTCGGGCCGCCGGCG
CGGGCGATGGCCGCAGCGACACCACCGGCATGCCGCAGTCGGGTGTTCGCCGCATTGGTGATGGCGTCGAGCTCGAGCTT
GGTCACGTCGGCCTGATGTACCTCCAACTCGATCATCGACACATTGTCCCCCTGCAAGTACTCGGCGGCCGCGGTGATG
CACCCCTTGTTGTGTTGGACCGTCGCCACCATCGCCCACACAATCGAACCCTCGCCCGGCGCCACTGCGGCCCATCGAGA
CTCCGGCCCATCGAGCCCAGATTCAGGGTAGCTTGAGGTGAACGAGGACAATCAAGCGGCTGGCAAGGACACAGACCGAT
GGCTCGTGATCCAGTTGTACCGAGGGTGCGAACAGCATGAGTGGCGACGACGCCGGGCCGGGCGAGGTCAGCCATGCCCG
CGGCGTCGGTGGGCCGGGCGGAGCCGGAGGCGCCGGTGGCCGGGGTGGTGCCGGCGGTCGCGGCGGGCGGGCGGTAGAG
GCGGAGATGGCGGCATAGGCGGGCAGCGGGCCCCGGCGGTCAACCCGGCCAGGGCGGGGTGGGCGGCGCACCCGGCCCC
GGTGGAACCCCGGCGAACCAGGTCAGCCCGGCAAACCAGGACAACCGGGGCAACCCGGCAGCCGGGACATTAGCGCGT
GCGGGTGGCGTCGTCGCGCATGAGCACGCATAGCCGCCATCTGCCCGGTACGCCCTTGAGTTCCTGCTCACCACGCTCGG
CGAACCGGTGCCGTGATCCGGCGACGATGTCTCGCACGGTCGAGGACACCAGCACCTCACTGGGTCCGGCCAGCGCGCAG
ACGCGCGCACCGATATGCACGGCCACGCCGGCGACGTCGGTACCGTGCGAGGCATCGCGCACCTCGACCTCGCCCGCATG
AATACCGATCCGGACCTCAATACCCAGCGCGGCGACCGCGTCGACGATGTCGTCCGCGCACGCGATCGCGGCACTCGGAC
TGGTGAACGTCGCGACGAAACCGTCACCGGCCGTGTTCACTTCGCGACCGCCGAACCGCTGGATTTCGTGGCACACGATG
GTGTCGTGGTTGTCCAACAGGTCGCGCCATCGGTCGTCGCCGAGCGCGGCGGCGTGCTGGGTCGAGCCGACGATGTCGGT
AAACATGATGGTGGCAAGCATGCGCTCGGCGTCAGCGCCGCCGCGCACGCCGGTGATGAATTCCTCGATTTCATCGAGCA
TCGGCCCGGTGTCGCCAACCCAGTACAGGGTATCGGTGCCGGGTAGTTCGACCAAGCGGGATCCAGCGATGTGCTCGGCG
AGGTAGCGACCATGTCCCACCGGGATGTACGTCGATCCGACACGGTGCAAGATCAGTGTTGGAGCCTCGATGTGTCCCAA
```

FIGURE 4(continued)

```
GACATCTCGTACGTCGGCCTCGGCTATGACCTTTGAAACGGCACGGGCAATGCTCGGCGGTCCGGCACGGTTGCCGGCGA
GATCCCACCAGGCTCGAAACACGTCATCTCCGGCCACGGTAGGAGCCACGATGCTCAGCACGTCGAAGCCCCGCTCGACG
GCATCCGGTTCCAGCGCCACCGTCAGGAACGGGTCAGCTCGACGAACCTGGGCGCCTACCGGGTAGTCGGGCGCCCATAG
TGGGCGCGCCGAGCCGTTGACGACGATCAGGCTGCGCACCCGCTCGGGGTAGTCGGCGGCGAGAACAAGTCCGTTCATGG
CGTGGAAACTGGGCGCGAAAATTGTCGCCTGCTCGCATCCGACCGCGTCCATCACCGCGATCGCGTCCTGGGCCCAGAAC
TTCGGCCCCAGCGTGGTTATCGCGGCGAGCCGTGACGACAGGCCGACCCCACGATGGTCGAGGCGGATCACCCTGCTGAA
TGACGCAAGACGGCGATGGAAACGGTACAGCGATGGCTCGTCGTCGATCGAGTCGATCGGCACGAACGGCCCCGGCAACA
CCAGCAGATCCGTCGGACCGTCACCCAGCACCTGGTAGGCGATATCCATGTCGCCGCATTTTGCGTAGCGGGTCCTGTGA
ATGTGGGGAGCCTGCGCCACGGTCCTACGTTAGTTCATGCGTAGGCTCATGGCGGTGAGCGCACGTGCGGGCATCGTGAT
CACCGGAACCGAGGTCCTGACCGGGCGGGTCCAAGACCGCAACGGCCCCTGGATCGCCGATCGGCTCCTGGAGCTCGGGG
TCGAGTTGGCACACATCACGATCTGCGGCGACCGTCCCGCCGACATCGAGGCACAGCTGCGATTCATGGCTGAGCAGGGT
GTGGACCTGATCGTCACCAGCGGCGGCCTGGGGCCGACCGCCGACGATATGACCGTCGAGGTGGTGGCGCGCTATTGCGG
GCGCGAGCTGGTGCTGGACGACGAGCTGGAGAACAGGATCGCCAACATCCTCAAGAAGCTGATGGGGCGAAATCCCGCTA
TTGAACCCGCCAACTTCGACTCCATACGCGCCGCCAACCGCAAACAGGCCATGATTCCGGCCGGATCGCAAGTGATCGAT
CCGGTGGGCACCGCCCCCGGTCTGGTTGTGCCGGGACGGCCAGCGGTGATGGTGCTTCCCGGGCCACCGCGCGAGCTGCA
GCCGATATGGAGCAAGGCCATCCAGACGGCTCCGGTACAGGATGCGATTGCCGGCCGGACGACCTACCGACAGGAGACCA
TCCGGATCTTCGGCCTGCCGGAGTCTTCTCTGGCCGACACACTGCGTGACGCCGAGGCAGCCATCCCGGGTTTTGACTTA
GTCGAGATCACCACCTGCCTGCGGCGCGGCGAGATTGAAATGGTCACTCGCTTTGAACCGAACGCCGCGAAGTGTACAC
GCAATTGGCACGGTTATTGCGCGACCGGCACGGCCACCAGGTCTATTCGGAAGACGGTGCGTCCGTGGACGAGCTGGTCG
CAAAATTGCTAACTGGCCGCCGGATAGCGACCGCCGAATCCTGCACCGCAGGGTTGCTGGCGGCACGGCTCACCGACCGG
CCCGGGTCGTCCAAGTACGTGGCGGGCGCAGTGGTGGCCTACTCTAACGAGGCGAAGGCACAGCTTCTCGGTGTGGATCC
GGCGCTGATCGAGGCCCACGGGGCGGTTTCCGAGCCGGTCGCCCAGGCAATGGCAGCGGGGGCGCTGCAAGGCTTCGGCG
CCGACACCGCCACCGCGATCACCGGAATTGCCGGTCCGAGTGGGGGAACGCCGGAAAAGCCTGTGGGAACAGTGTGCTTC
ACCGTCCTGCTGGACGATGGCCGAACAACCACCCGAACCGTGCGGCTGCCCGGGAACCGGTCAGACATTAGGGAGCGCTC
GACGACTGTGGCGATGCACCTGCTGCGGCGCACCCTGAGCGGTATCCCGGGCTCACCCTAGCGACGGCGAAATCGACAGC
AGCGCGACAAAGTTCGACGAGAAGCACCGCGCTAATGTCGATTTCGATGACGAACAAGAAAAGCAGTTTCCGTAGTACC
AAAGCGGATTCCGGTGGCATCCTTGCCAATCGCCGTCAGCACCGCTACGACCAATAGCACGGGCACGATCGTCGCGGCCA
AGGCGAAGGGGTAGCCATGGGATTCGGCCAGACGCTCTTGAATAGGAAGGTTGAACGCCGCCAGCAGATTACCGAGCTGG
TAGGTTACGCCGGGGTAGACGCCCCGGATAGCGTCTGGCGACATCTCGGTCAGATGCGCGGGGATCACACCCCAGGCACC
CTGTACGAAGACTTGCATCAAAAACGAACCCAGGCACAACATCGCCAGTGCGCGAGTAAGCGAACAGCGGCACGATCG
GCAGTCCCAGCGCCGCACAGAAAACGATGGTGTAACGGCGGCTGAACCGCTGGGACAACGTGCCGAACGCCAGACCGCCG
ATGATGGCGCCGATGTTGTAGATCACCACTATCCACCTGGCGGTCAGGCTGGACAAACCGGCACCATGATCGGTAGTCGC
GGTCAGGAAGGTCGGGTAGACATCCTGGGTGCCGTGGCTCATCCAGTTGAAGGCGGTCATCAACAGCACTAGGTAGACAA
ACCGGCGCACAATTGCGGGGTTACCCAGGACATCGCGGATTCGGGTCTTGGTGAGCCGCATGCGGTCCTGCGCGGCTTCC
CAGACTTCGGATTCCTTTACCCGGTACCGGATGATCAAGCTGATCAGAGCCGGGATGATGCTTAGGCCGAACAACCACCG
CCACGACAGCCCTAGCCAGTTCATCACCACCAGCGCTGCCACACTGGCCAGCAGATAGCCGAACGCGTAGCCCTCCTGCA
GCAGCCCGGAGAAGACGCCACGCCGCTCGGCTGGAACCTTCTCCATGGACAGCGCGGCACCCAGCCCCCACTCTCCGCCC
ATGCCAATGCCGTAGAGCAGTCGCAGGATCACCAGCACGGTGAAGTTGGGTGCGAATGCGCACAGAAATCCGATCACCGA
ATAGAACGACACGTCGACCATCAGCGGGACCCGCCGGCCCACCCGGTCGGCCCATAGCCCGAACAGCAACGCACCCACGG
GGCGCATGGCCAGGGTGGCGGTGGTGAGAAACGCGACGTCGGTCTTGGTGTGGTGGAAGGTCGTTGCGATGTCGGCATAG
ACCAGCACCACGAGAAAGTAATCGAACGCATCCATCGTCCAACCCAAGAAAGATGCCATAAAAGCGTTTCGCTGGTCGCC
GGTCAACCGCGGTGCTGCCACGTCTGCATCGTGGCGTACCGGGCGCGGCACCGCGAGTCCGGGGACATGGCGAACAGCGG
CGGCTCGCATGTCCGTGGCAGGATCGGGCAATGGTGCCTTTCTGATGCGCGCCGCAGTGACCGGATTCGCATTATGGGT
GGTGACTCTTTTCGTCCCGGGCATTGCGGGCGGCGACACAACGCTGCAGCGGGTCGCCATCATCTTCGTCGTCG
CGGTGATCTTCGGTCTGGTCAACGCGTTCATCAAGCCCATCGTGCAGATCTTGTCGATCCCGTTGTACATCCTGACTCTC
GGTCTTTTCCATGTAGTCGTTAACGCGTCGATGCTGTGGCTTACCGCGTGGATCACTGAGCACACCACCCACTGGGGACT
GCAGATCGACCACTTCTGGTGGACCGCGATCTGGGCGGCGATCTTGTTGTCGATCGTCAGCTGGATCCTGTCGCTGTTGG
CTCGTGACTTTCGACGTGTCACTCGCGCACACTAGAGCCACAAATTTTGGTGGGGGACATCCTAGGTTTTCGGGGCATG
TTCCACTTATGCTTACTCACACTGCTTGCCAACCTCGTCCAAGACAGGCACCCTGTCTTCGGCGTGATGACGCTGACCTC
CCGCCCTCCAATACGCCGGACGGCAGCACCTAACAGCACACGACGACGGGACTGCAAATGATGCGCACTGTCGCGATTGG
ACCAGGTGCCGGTCCTTCGAGCACACGGCCGAGTTCGCAACCCAGTGACCTGCATAGCGGCCTACGCGCGGTTACCGAGT
GCACCGGCTCAGCGGTGGTCGTTCATGTGGGCGGCCGACATCGACGCCAGTAACGAGGTCGCTTGGCAGCGTCTGGTGAGC
AAGAGCGCCGCTATCGCCATCGCGCCGGGTCCGTTCGTCATCGACATTCGGGACCTCGACTTCATGGGATCATGTGCATA
CGCTGTGTTGGCCCAGGAGTCGGTGCGGTGTCGCCGGCGCGGGTGAATATGCGGTTGGTGAGTAACCAGCCGATCGTGG
CCCGCACCATTGCCGCGTGCGGACTGCGGCGACTAATTCCGCTGTATGCAACGGTCGAGACCGCACTGGCGCCGCCTCCC
AGCGCGCATTGACCGACCCATTAACCGACCGGTGCCACCCAACCCGCCATGGTGTCGGGTTAACCGCCGCCGACAAGATT
```

FIGURE 4(continued)

```
GACCACCTCCCGCGCACAACCCCATGACAGGGTCACGCCGTCACCTCCGTGGCCATAGTTGTGGATGCACAGCGCTCGCC
CGATCGGTTCAGCTTCCACCCGCACGGACGGCCGATCAGGACGCAGCCCGGTAATCGTCTCAATCACTGCCGCCTCGGCA
AGCCGTGGTTGTATGCGGCGACACCGTTGCAGGATCCGCTCGGTTATCTCCGGCTCTGGGGTGGGGTCCCACCTGCCAGG
GATACTGATGCCGCCGCAGACTACACGCTGCGGGTGGGCAAAGTAGCAGATCCATTCCGAGCCGCCGGTGCGCTCGATAA
ACAGTTGCTCTAGACCTGGATTGGTGAGGACGACGTGCTGGCCGAACCGCGGCCAGACCGTGGCGTCGCCGGCCAGTTCC
CGAGCGCCCAGACCAGCACAGTTGATCACTATGGGCGCCGCCCTCAGCGGCCTCGGCCAGCGACCGTAGCGGGCGCGTTTC
GATTTCACAGCCAGTCGCCGCCAATCGCTGGGTCAGACAGTCGAGGTACTGGGGCATATCGATCATCGGCAAGGTGGCAT
GAAACCCAGCACGGAAGCCCCCGGGCACGTCGGCCGGGTCAGCCGGCCGCACGTCGGGGATCAGCTCCAACCCGGGCGGC
ATCGCACCGGTCTCGATACGATCGCCGACACTCAGCGCCGGCGTCATGCGCACGCCGGTGGCGGGATCCTTGGCCAAGTC
GCGAAACACGTGCAATGACTGTTCGATCCACCCGCGTACCTTGGCAACGGGTTCCTTCGGCCGCGGCCCCAGACCGCAC
CCGCCACCGCCGATGTCGTTTGCTGCGGCAATGCGGCCGCCCATACCCGCACCGGCCACCCCGCCTCGGCCAGGCATATG
GCCGACGTCAGTCCGCTGACGCCGGCCCCAATCACGATGACCTGTTGCTCACCTATTGCCACAGCAGGACCGTAGCCGAA
GCCAGCGTCAGTTAGGGCTGAGGCACTCGCCCTCCAGTCGGTCCGAGTAAGCCGTTGAGGATGCCGAGCTGATTTTGTAG
TTGGGCCCCCGCTTCAGGTCCAGGAACTCCGGCAGGGGCAGCGCCTTCGCTGCCCGTGTTCTGCCAGGGTTGGCAGCCGT
GCGTCTTGAACGCCTTGTCGGTCGGCTCAATCGTCACTACCTGTGGTTTCTTGCTGAGTGCGTTATCGATGAGCGCGCCA
TCGGGGTTACCCATCCGCTTCCAATAGCAGGTGCCGTCGCCGACGGGTCCCGCGGAGCTGTACGTGCCGGGAGCGATGTC
AATCCCCACCGCATAGGTGCCGTCGCTATCAATTGCCGTCTTCGGTGTCGGTGCCGGCTCCGGATCGGCGCCGGCGAGGC
CCACGGATCCGGCCCAGCCTGCGAGGATCAGGCCGGCGACGGCAAAGGCTGCAGCAGGAGATGGGGCTGGCTTCAAGCGC
ATCACACAATAGCCTACTGGGGCCTACCGGTATCCGGAACTCACTCGGCCTGGAAGCAATCACTCGTTCTCCCGCCGCCG
ATGGGCTTGTTCGATCCCCATATGCGCCTGCGAGCGCACGGACGGCGCGCCACCGACGCAGTGTCCGGCAATGATGCGGT
AAATCGCGGACGGCGCCAACGCTTCCACCGAGTCACAGCCTTGTCCGCCAGCACACCGCCCAGACCGCATGTATCGGAGG
ATGTCCGGAAGCCGTTGGCCACCTCCGTGTCGAGCAACCACCGCTGTCACTGCATTGCTGTCACTAAATCGTTGTCCGGC
AACACGTTTAGAGCGCTCGCGTCAGGCTGACCTCCTGGTGGCTCGCATCCCGAGCACCGGCTGGGTACCGCGACCTTCGT
CGAAGTCCGCCGCCCACGGCCAGCGACCACGCCGGTCGGCCCACACCAACTGCAAGGCCGTCACCTTGTCGCCAAAGATG
GCGATCGCACAATACAAATGCGCGTCCGGATGTGTAACCTGGACCGTTTCGACAAGAGGGCCGGCTGGGAGGGTGGTCTG
CATACCGGAGTCAGCAAGTCACCGACCAGAGCCCTGCGAGCGGCGATGTTCAACAACCGCTGCCCACGTCGTGGCGAGA
GGCCAGTCACCACCAGTTCGGGCAAGCCGCGCGGGTTAGACCAACCGTGTAGGCAAATGGCCGTCGCTCGCACTCCACG
TGCTGTACCGCCCAGCCATGCATGAGCATTATCCCGTACACCTCGTCGAGGTACTCCTCGGCGGTGGCTTCCGGGTGATC
GCACATCCAGCACATTTCGGCGCCCTTTCTCCTCATCCCCGTCTCGTCATCCCCGTCTCGTCGTGCCTGCGACCACCATG
CACGCGGGTCTGACAAATCGCGCCGGGCAAACACCAGCACCCCGCGAGCCGGTCAGCTCGCGGGGTGCTGCGGCGGGTT
GTGGTTGATCGGCGGGCAGGGCCGATCAACCCGAATCAGCGCACGTCGAACCTGTCGAGGTTCATCACCTTGTCCCAGGC
AGCGACGAAGTCCTGCACGAACTTCGGCTGCGCGTCATCGGCGCCATAGACCTCGACAAGCGCCCGCAACTCCGAGTTGG
ACCCGAAGACCAGGTCCACGCGGCTGCCGGTCCACTTCACCTTGCCACTGCCATCCTTGCCCTGGTAGGTCCCGTCATCT
GCTGGCGAGGGCTCCCAGGTGATACCCATGTCGAGCAGGTTCACGAAGAAGTCGTTGGTCAGTGACTCGGAGGCCTCGGT
GAACACGCCCAGCGGTAAGCGCTTGTAGTTTGCGCCGAGGACGCGCAGGCCACCTACCAGCACCGTCATCTCAGGGGCAC
TGAGCGTAAGCAGGTTCGCCTTGTCGAGCAGCATGTACTCGGCCGGCAACGGGTTGCCCTTTCCGAGGTAGTTTCGGAAG
CCATCTGCCTTGGGCTCCAGCACGGCAAAGGATTCCACGTCGGTTTGTTCCTGCGACGCATCCGTGCGGCCCGGGGTGAA
GGGCACCGTGATGTTGTGGCCAGCCGCCTTTGCTGCTTTCTCTATGGCGGCACAGCCACCGAGCACGACGAGGTCGGCGA
AGGACACTTTGATGTTCCCCGGCGCCGCGGAGTTGAATGACTCCTGGATCTCTTCCAGGGTGCGAATGACCTTGCGCAGA
TCCCCGTCGGGGTCGTTGACCTCCCACCCGACTTGTGGCTGCAGGCGGATGCGACCACCGTTGGCGCCGCCGCGCTTGTC
GCTACCACGGAACGACGACGCCGCCGCCCATGCGGTCGAAACTAGCTGTGAGACAGTCAATCCCGATCCGGATCTGGC
TCTTAAGGCTGGCAATCTCGGCTTCGCCGACGAGGTCGTGGCTGACCGCAGGGACCGGATCCTGCCACAGCAGGGTCTGC
TTGGGGACCAGCGGCCCAAGGTATCTCGCAACGGGACCCATGTCTCGGTGGATCAGCTTGTACCAGGCCTTGGCGAACTC
GTCGGCCAATTCCTCGGGGTGTTCCAGCCAGCGACGCGTGATCCGCTCATAGATCGGATCCACCCGCAGCGAGAGGTCAG
TGGCCAGCATCGTCGGGGAGCGCCCTGGCCCGCCGAACGGGTCCGGGATGGTGCCGGCACCGGCGCCGTCCTTGGCGGTG
TATTGCCAAGCGCCAGCAGGGCTCTTCGTCAGCTCCCACTCGTAGCCGTACAGGATCTCGAGGAAACTGTTGTCCCATTT
CGTCGGGGTGTTCGTCCATACGACCTCGATGCCGCTGGTGATCGCGTCCTTACCGGTTCCGGTGCCATACGAGCTCTTCC
AGCCCAAGCCCATCTGCTCCAGCGGAGCAGCCTCGGGTTCGGGGCCGACCAGATCGGCCGGGCCGGCGCCATGGGTCTTA
CCGAAAGTGTGACCGCCGACGATCAGCGCCGCTGTTTCGACGTCGTTCATGGCCATGCGCCGAAACGTCTCGCGAATGTC
GACCGCCGCGGCCATGGGGTCCGGGTTGCCGTTCGGCCCCTCCGGGTTCACGTAGATCAGCCCCATCTGCACCGCGGCCA
GCGGGTTCTCCAGATCCCGCTTACCGCTGTAACGCTCATCGCCGAGCCAGGTGGCTTCCTTGCCCCAATAGACCTCATCG
GGCTCCCACTGGTCGACCCGGCCGAAGCCGAACCCGAACGTCTTGAAGCCCATCGATTCCAGCGCGCAGTTGCCGGCGAA
AACAATCAGGTCCGCCCATGAGAGCTTCTTGCCGTACTTCTTCTTGACCGGCCACAGCAGCCGGCGCGCCTTGTCCAAGC
TGGCGTTGTCGGGCCAGCTGTTAAGCGGCGCGAACCGCTGCATGCCGCCCCGGCGCCGCCGCGGCCGTCGTGGATGCGG
TAGGTGCCGGCAGCGTGCCACGCCATCCGGATAAACAGCGGCCCGTAGTGGCCGTAGTCGGCGGGCCACCACGGCTGCGA
GGTGGTCATCACTTCCTCGATGTCCCGCGTCAGGGCGTCAACGTCGATGGTCGCGACCTCCGCGGCATAGTCGAACGCCG
```

FIGURE 4(continued)

```
CACCCATCGGGTCAGCGACGGCCGGGTTTTGGTGCAGTACCTTCAGATTGAGCCGGTTGGGCCACCAGTCCTGGTTTCCG
CCGCCCTCGACGGGGTATTTCATATGACCCACGACGGGACAGCCGTTGCTAGCGGCTCCGGTGGTGGTTTCTGTAATGGG
TGGGTGTTGCTCGGGCACAGCATTCCTTCCAGGAGTTGGTGTTATCGGGCTGTGATCACGGATGTGATCGCGAAGTGTCG
GATATCGAACAATCAGGACATAGACCCCAGTAGATGACCTCCGCCTCGTCCAACAGGAAGCCGTTATGGTCCGAGGCCGT
CAGACAGGGTGCCTCGCCAACAGCACAGTCGACATCGGCGATAACCCCGCAAGACCGGCAGACGATGTGATGGTGGTTGT
CGCCGACCCTGGACTCGTAGCGCGCGACGGAGCCCGAGGGTTGGATCTTTCGCACCAAGCCCGCGGCGGTCAGGGCATGC
AGCACGTCGTACACGGCTTGCCGGGATACGTCGGGCAGCGCAAAACGCACGGCACCGAAAATCGTTTCCGTGTCGGCGTG
TGGATGCGCATTCACTGCTTCCAGGACGGCGACGCGCGGTCGGGTCACGCGCAGGTCGGCCGTCCGGAGCTGTTCGGCGT
AGTCCGGTATAGAGGACACACTAGACAATATGACTCCCTTTTCTGGAATCAGTCAAGACTTTGGCTAGCGTGACAGGCGT
CTGCTAGGACCCGATCGCCCCGGGGCCGCTGGATCGTGGGATGGCGGGTGGATCAGCCTTCGTATGTTCCGATGAGCCGG
GCCTGCATGGTGGCGGCCTGCGCGATCACCCGCGCCGCCTTGTGTCCCAGCCAGTCCCGCGAGTGGAGGCACGGCAGGAAG
GTGGTAGAGGGTAAACCGGTAGTGGTGTGTCCCGGTGCCCGCCGGCGGGCAGGGGCCGGTGTATGCGGGCTGACCGCTGG
AGTTCGGCAGGCTGATTCCGCCACCGGGAGTCTCACCATCGGCGGTGCTGCCAGCACCAGGGGCGATCCCGATCACGATC
CAATGGACGTAAGGTTCGCGAGGTGCGTCCGGATCATCGACAACGAGTGCGCCGCCAAACGGCGCCGACCAGGTCAACGG
AGGCGCGATATTGGCTCCTTTGCAGGTGTACTGTTCCGGATCGGCGCACCGTCGGCGAATGCCGGACTGCTGATTGTCA
GTACATCGCCGGTAGGCGTTTCGGGCATACTCCGACCGAGCGCTGCTGCTTTCGGCGCCAGCGGCGCCGCCTTTCGACTG
TCACCGTTGCCACCGTAGGCAACTAGCGCCACGGGGAGCGCCAGCCCCAAGATGGCCAGTGCGAACCGGTGAAATGCGTG
CGCCACTGTCGATTCCATATTGATCATTGTCGCCAGGCGCAATTGGAGAAGCCAGGGTTTCGACCACCTCGCCAGGGATG
CCGGCGCGTCAGCCTTCGAATGTGCCGACGAGCCGGGCCTGTCCGCTGGCGGCCTGTGCTATCGCCTGTGCCGCTTGGAC
TCCCGTGGCTCCCGGTGGCAGCTGGAGCGCGACAGGAAGGTGGTAGAGGGTAAACCGGTAGTGGTGTGTCCCGGTGCCCG
CCGGCGGGCATGGACCGAAGTATCCTTGCCGACCACCAGAATTCGGCACGCTGTGCCCACCAGCAGGAGTCTGACCATCC
GCCGTGCTGCCAGAGCCAGGGGCGATTCCGGTCACGATCCAGTGCACGTACAGTCCGCCGACCGCGTCGGGGTCATCGAC
GACGAGTGCCAGTTCGGCTGCGCCCGCGGGCGACGACCACGTCAACGGTGGCGCCACGTTGGCCCCCTTGCAGCTGAATT
GCACCGGGATCGGGGCGCCGTCGGCGAACATGGGACTGGCGATCGTCAGTGGCTCGGCGGCCGGCGCCGGCGTTGTTGCG
TCGACGGTCGTCGCTTTCGGCACGTATGGCGGTGTCTCTCGACTGTCACCGCCCCGCCCCCGCAGCCACCCAGCGCCAC
TACGAGCGCCAGCCCCGCGGTGGCTAATGGGGTTCGGTGAAGTGTGCTCGTCATTGGAGATTCCATAGCACATTGTTACT
AACTGGGATTCGAGAGTACAGCTGTTTTGCGGCCGCGCTTACCAGACAGCCGGGCCCCGGGCCACCCATCGCCTCACGGT
ACCAGCACCACCTTGTCGACGTTCTCCCGTGCGGCCAGAATCCGATGTGCTTCAGGAGCTTCGGCGAACGGCACGATTGC
ATGAACGATCGGCAGGATCGTTCCGTCGTTGAGCGCCTTGGTCAGCGGCGCGATCCAGGGTTCAAGGGTGCGGCGATCGT
CCCACAACCGCAGCATGTTAAGACCGATCACGGTTTTCGACTCCTCGAGTTGTTTCATCAGGTTAAAGCCGCGCAGCATT
GACAACGCGTGGGGCGCCACCCTGCGCATCGATCGTTTCTCGCCGTGCTGCATATTCGAAATCCCGTAGCCAACCAGCCT
TCCACCCGGGCGCAGCAGAGTGTAGGACCGCCGCAGCGAGGTGCCGCCGAGCGCGTCAAGCACGACGTCATACGGGCCCA
ATCCCTGCCACCAGCCGTCCCGGCCGGTAGTCGATCGCGCGGTCCACACCGAACTCGGCCAGCTTCTGATGTTTTTGGGGT
GATGCGGTGCCGTGCACTTCGGCCTTGGCTGCTTTCGCGAATTGGACCGCCGCGATGCCGACTCCACCGGCCGCGGCGTG
AATCAGCACCCGCTCACCGGCGCGCAACGATCCGTAGCCGTGCAGCGCCGCCCAGGCGGTCGCGTAATTCACCGGGACCG
CGGCACCCTGTTCGAAGCTCAGCGCATCGGGGAGCACAACCGAGTCGGTGGCCGCAACGTTGACGATCTCGCAGTAGCCA
CCAAATCGTGTACCGGCCAGGACTCGTTCGCCGACCCGGTTCGGGTCGACCCATCACCGACAGCCTCGACCGTCCCAGC
GACTTCGTATCCGACCACCGCCGGAAGTTTCGGCGCGTCTGGGTACAGGCCGACGCGGGCGAGATGGTCAGCGAAGTTCA
CCCCTGCTGCGCGGACGGCGACCCGCAGCTGGCCCGGGCCCGGTGGCGGCGGGTCCGGTCGCTGCCGCACCTGCAAGACC
GATGGGTCGCCATGTTTGGTGATGACCACTGCTCGCATAATGTTCTCCTTGTCAGGCTTGACGGGTCGCACCCGCGAACA
CCCCTCTGTGATAGCACGAGTTATCAGGAGGTTCGGCGGGGCGTTACCTTTGCGGTTGTGCACTTCGACTGGGAGCGCCT
GACCGACAGCGTGCATCGCTGCCGGCTGCCGTTCTGTGACGTCACCGTTGGGCTGGTCCGGGGCCGCACCGGAATACTGC
TCGTCGACACCGGGACCACCCTCGGCGAAGCAACAGCAATCGCGGCCGACGTCAAGCAGATCGCTGGTTGCCAGGTAACG
CATGTTGTGTTGACACACAAGCATTTCGACCATGTGCTGGGTTCCTCGGTGTTCGACCAAGCGGAGGTGTTCTGCGCTCC
CGAGGTCGTCGAATACCTACGGTCGGCTACCGACCGGCTCCGCGAAGATGCCCTGAGCTACGGCGCGGACACAGCTGAGG
TTGACCGCGCGATCGCGGCCCTGAAACCACCTCAGCACGGGATCTACGATGCAGCCGTCGATCTCGGGGACCGCACCGTC
ACCATCACTCACCCCGGCAGCGGCCACACCACAGCAGATCTCGTCGTGGTGGCGCCGGCCACCGGCCATGCAGACGGCCC
AACGGTGGTCTTCACGGGTGATCTTGTCGAGGAGTCAGCCGATCCTGATATCGACGCCGATTCCGACCTGGCGGCCTGGC
CGGCAACGCTTGATCGGGTACTTGCGATCGGCGGCCCTGACGCCAGCTACGTCCCGGGGCACGGGAAGGTCGTCGATGCG
CAGTTTGTCCGTCGCCAGCGCGCCTGGTTGCGAACACGTGCGAGCCGCCAGCCTCGTGAAACGCCAGCTACTTTGCCGTG
CAAGCGGTGACGAGCGCATCCGGGTCGGTAACGCTGACCCACAATTCGCGCACCGTCATCGACTTCTTCCACATCTTTGC
CTGTTCGGGCGGATCGATCGTCAGTGCCACCAGGCCCTTACGTGACCCGTTGACCAGCCAGCGGCCGAATCCAAAGTGCA
CCCCGGCTGCGTAGACCCTTGCGTTGGTCGCCTCTGCCTTCGTGATCGACGTCAACGGGATGTCGGCGGCAAATGCCCAT
CCCATCTTGACGTGCAGGCTCCCCGCCCCAACCCATAGCTCGCTGTTCTTGGGGCCGAGCCCGAGCGGCACCGCAAGCGG
GAGAAACCAACGGTCAAAGCGCAACTGGGTCGGCACCAAGATGACCCTACCGGTGCTAGTGCGGCTCAGTACCATGTAGG
AGTTAGTCTCGAACCGCCCCAGTGGCGTTGCGGAATTTGCGAGCCGTCATCGGTCAGTGATCTAGGTCGCCCGTCCGGGG
```

FIGURE 4(continued)

```
ATACACTCGGTCCGTCAGGTGAATCGGGGCTGCAGAGGAGCGCAAGGCCATGGCCATCGCCGAAACGGACACCGAGGTCC
ACACACCGTTCGAGCAGGACTTTGAGAAAGACGTAGCCGCCACTCAGCGATACTTCGACAGCTCGCGCTTTGCTGGGATC
ATTCGGCTCTACACCGCCCGCCAAGTCGTGGAACAGCGCGGCACGATCCCCGTCGACCACATCGTGGCGCGAGAGGCGGC
GGGCGCCTTCTACGAGCGTCTGCGCGAACTCTTTGCAGCCCGCAAGAGCATCACGACGTTTGGCCCCTACTCGCCGGGGC
AGGCGGTGAGCATGAAGCGGATGGGTATCGAGGCGATCTACCTCGGTGGTTGGGCTACCTCAGCTAAGGGCTCCAGCACC
GAAGATCCGGGGCCCGACCTCGCCAGCTACCCGCTGAGCCAGGTGCCTGACGATGCCGCGGTGCTGGTGCGCGCCTTGCT
CACCGCGGACCGCAACCAACACTATCTACGCCTGCAGATGAGCGAGCGACAGCGTGCGGCGACACCGGCTTACGACTTCC
GCCCGTTTATCATCGCCGACGCCGGCACCGGCCACGGCGGCGATCCGCACGTACGCAACCTGATCCGCCGCTTCGTCGAG
GTCGGTGTGCCGGGCTACCACATCGAGGACCAACGACCCGGCACCAAGAAGTGCGGCCACCAGGGCGGCAAGGTCCTGGT
GCCGTCCGACGAACAGATCAAGCGGCTCAACGCCGCCCGCTTCCAGCTCGACATCATGCGGGTGCCCGGCATCATCGTCG
CACGCACCGACGCGGAGGCGGCCAACCTGATCGACAGTCGCGCCGACGAGCGTGACCAGCCGTTCCTTCTCGGCGCGACC
AAGCTCGACGTACCGTCCTACAAGTCCTGTTTCCTGGCAATGGTGCGGCGTTTTACGAACTGGGCGTCAAGGAGCTCAAT
GGTCATCTTCTCTATGCGCTTGGCGACAGCGAGTACGCGGCGGCCGGCGGTTGGCTTGAGCGCCAAGGCATTTTCGGCTT
GGTCTCCGACGCGGTCAACGCGTGGCGGGAGGACGGCCAGCAGTCGATCGACGGCATTTTCGACCAGGTCGAGTCGCGGT
TCGTGGCGGCCTGGGAGGACGACGCGGGCCTGATGACCTACGGAGAGGCCGTGGCGGACGTGCTCGAATTCGGTCAGAGC
GAGGGCGAACCCATTGGCATGGCTCCCGAGGAGTGGCGGGCGTTCGCCGCGCGTGCATCGCTGCATGCCGCCCGGGCAAA
GGCCAAGGAGCTGGGCGCCGATCCGCCATGGGACTGCGAGCTGGCCAAGACCCCGGAGGGCTACTACCAGATCCGCGGCG
GCATACCGTATGCGATCGCCAAATCGCTGGCCGCGGCACCGTTTGCCGACATTCTTTGGATGGAGACCAAGACCGCCGAT
CTCGCCGACGCTCGACAGTTCGCCGAGGCGATCCATGCCGAGTTCCCCGACCAGATGCTGGCGTACAACCTCTCACCATC
GTTCAACTGGGACACCACCGGCATGACCGACGAGGAGATGCGGCGCTTCCCCGAGGAGCTCGGCAAAATGGGCTTCGTCT
TCAACTTCATCACCTATGGCGGGCACCAGATCGACGGTGTCGCGGCCGAGGAATTCGCCACCGCGCTGCGCCAGGACGGC
ATGCTGGCGCTGGCTCGGTTGCAGCGCAAGATGCGCTTGGTCGAATCTCCCTATCGCACACCGCAAACGCTAGTCGGCGG
GCCGCGCAGTGACGCCGCATTGGCTGCCTCCTCCGGACGCACGGCGACCACGAAGGCAATGGGCAAGGGCTCCACCCAGC
ACCAGCACTTGGTGCAAACTGAGGTGCCGCGCAAGCTGCTAGAGGAATGGCTGGCCATGTGGAGCGGTCACTACCAGCTC
AAAGACAAACTGCGCGTACAGCTTCGGCCGCAGCGGGCCGGCTCGGAGGTGCTCGAGCTCGGCATCCACGGCGAAAGCGA
TGACAAGCTCGCCAACGTGATATTCCAACCGATCCAAGATCGCCGCGGCCGCACCATCCTGTTGGTACGCGACCAGAACA
CGTTCGGTGCGGAACTACGCCAAAAGCGGCTGATGACCCTGATCCACCTCTGGCTCGTCCACCGCTTCAAGGCGCAGGCG
GTGCACTACGTCACGCCCACCGACGACAACCTCTACCAGACCTCGAAGATGAAGTCGCATGGAATCTTCACCGAGGTCAA
CCAGGAGGTGGGCGAGATCATCGTCGCCGAGGTGAACCACCCGCGCATCGCCGAACTGCTGACGCCCGATCGGGTGGCGC
TGCGGAAGTTGATCACGAAGGAGGCGTAGCCAGCGCTGCCAACTGTCTTGGGGGCCAACCGGGTGTGCGTCGAGGTGGCG
CACATCGCGAAACGCGAAGGATGCTGTCAGACGGCGTCTGCGGTGGCCTGTCGAAGATCCAGCGCACCGGCGTTCACCTG
CGTCGGCCCGCGGTCGCGACTACCATCGCCGCCCCGTTTACGGCCCGGCACCCGGTGAGAAGAAGCCCAGGAGCATTTG
GCCGATGTTGTTGACGCCGAGTTAAACGCAGCGGTGAGGTGACCAACGGTGCTCGTGTTGTTGAAGCCCGAGACGGTGT
TGCCTAGGTTCGCCACGCCCGACGCCAGCTGCCCGACGTTGTAGATTCCCGAGACTCCGCCTTGCAGCGCGTTCGGCACC
TGGTTCCAGAGGCCCGAAATGCCGGGCCCGACGTTGCCGAAGCCGGATGCGCTTCCATCGCCACTGTTGAAGAAGCCCGA
AGACGGGTGGTGGTGGAGTTTCCGAAGCCCGGGGCGCTCGTGATGTTGATCGGGATGTTGATCGGTCCCAAGCCGCCGT
TGGCGGTCAAGTTCAGGGGGGATCCGGGAATGGTGAAGCCGGGGATCGTAACCGGGCTCGTGCCCCCGCTCAACGGAACA
TTCAACCCAAACGGATTAATCGCGAAACCAGGGATCGTAACCGGGCTCGTGCCCCGCTCAACGGAACATTCAACCCAAA
CGGATTAATCGCGAAACCAGGGATCGTGACAGCGTTGGTAGCACCGCTCAGCGGAATATTCAAACCGAACGGATTAACAC
TGAATCCCTGGATGCCAGACTCCAGGGTGCCGCCGCCAGCGTGACGCCTAATACGAATGTGCTAAGCGGGATGGGGCCG
ATGTAGCCCGTGAAGATACCAGCGACGTTAAACGGAAGTTCGTTGAGAGTGATGTTGACCGGTATCCTGATGTTAATCGT
AAGGGGGATGCGGGAAATAGGGACGCCGGGAACGGTGATCGGACCGACACCACCCAGCGCGTTCAGGCTCAACGGAATAC
CAGGAATAGTAATATCAGGCACCACAATCGGACCGACACCACCCAGCGCGTTCAGGCTCAACGGAATACCAGGAATAGTA
ATATCCGGCACCACAATCGGACCGACACCACCCAGCGCGTTCAGGCTCAACGGAATACCAGGAATAGTAATATCCGGCAC
CACAATCGGACCGACACCACCCAGCGCGTTCAGGCTCAACGGAATACCAGGAATAGTAATATCCGGCACCACAATCGGAC
CGACACCACCCAGCGCGTTCAGGCTCAACGGAATACCAGGAATAGTAATATCCGGCACCACAATCGGACCGATGCCACCA
TTCACTTCGACGCTCAGTGGGATGCCGGGAATGCTGAGTGTGTCTGAGTAGCCAATCAGACCCTGGTAATCGCCCCTCCA
CAGTATGCCGTTGCTGTAGCTGCCCGAGATCAGGGCGCCGGTGTTAAGGTCGCCAATGTTTCCCCAGCCGGTGTTGAGGT
CGCCGAGGTTTAGGTACCCCGTGTTGGCGTTGCCCGGGTTGAGGTCGCCCGTGTTGGTGTCGCCGGCGTTGTAGCTGCCT
GTGTTGTAGCTTCCTGCGTTGCCGATTCCAGTGTTGACGTTGCCGGTGTTGAACAGGCCCGTGTTGGCGTTGCCCACGTT
ACCCAGGCCGGTGTTGTAGTTGCCGGAGTTGCCGATGCCGACGTTTCCGTTGCCTGAGTTGAAGAAGCCGATGTTGCCGT
TGCCGGAGTTGAAGAAGCCGATGTTGCCGCTGCCGGAGTTCAGCGCCCCGAATCCGACCTGATTGTCGCCGGTGAGCCCG
ATACCAATATTTCCAGTGCCCGTGTTGCCGAAGCCGATGTTGCCGTTACCGATGTTCGCGAAGCCGTAGTTGTTGCCGCC
GATGTTCCCAAAGCCAATGTTGTGCAGGGCCTCCGTCAACCCCGGACCCGTGTTTGCAAACCCAAGGTTGTTGCTGCCGA
CGTTTCCAAAACCGAAGTTGTTGCTTCCGATGTTTCCGAAACCGAAACTTCCGTTGCCGATGTTTCCGCTACCGAAGTTG
TAGCTACCGACGTTTCCGCTACCCACGTTGTAGTCGCCGAGGTTTGCGTTGCCCAAGTTGAGTGTGCCGTCGTTGGCGAA
```

FIGURE 4(continued)

```
GCCGAAGTTGAATAACGTCCCACCTGCGGCGTTGCGCATGAAGCCGGCGAGTTGGCTGTCGGTGTTACCGACGCCGGAGT
GAAAGGCCGATGTCGCTAGGCCCAGCGTGCTGGTGTTGTAGAGGCCTGAGACTGTGTTGCCGAAGTTCAAGATTCCCGAT
GTCAGTGGCCCGACGTTAAGGAATCCGGAGTTGCCGAGATTCCCAGCAATGTTCCAGAAGCCAGATCCGCCCGAACCGAC
GTTCCCGAAACCCGATGTGCCGCCCGTACCGCTGTTGAAGAAGCCCGATGACGGGGTGGTGGTCGAGTTTCCGAAGCCTG
GGGTGCCCGCGATTTCGATCGGGATGTTGATCGGCCCGAGGCTGCCGGACACGTCGATGCCCAACGGGATTGAGGGGATC
GTGATTGGCGGGGTAGTGAGGGGGCCGATGGCGCCGCCCACATCAATACCCAACGGGATTGCCGGAAGTGAGTAGCCATC
CGGGAACACCGTAAACGGGCCTAACCCTCCGCCCACATCAATACCCAACGGGATTGCCGGAAGTGAGTAGCCATCCGGGA
ACACCGTAAACGGGCCTAACCCTCCGCCCACATCAATACCCAACGGGATTGCCGGAAGTGAGTAGCCATCCGGGAACACC
GTAAACGGGCCTAACCCTCCACCCACATCAATACCCAACGGAATAGCCGGCAAACTATAACCACCCGATAAGAAGGTGAT
GGGACCGATTTGACCACTCACTGTCACGTAATCTGGAGGGAATCCGGGGAAAAATGGCGGAATCGCGGGAATCTCAGGAG
TGCCTAGCTGTATCGATATGCTACCCGGGCCTATGCTGCCAACGGTGGGATTTACGCCGAATAAGCCGATCGCAAGCGGA
GACGCGGGGATCGAAATCGATCCCACGTTAATGACCTGGAACGCCGATAGCTCTAGGCCAATAGAATTTAGAGTGATCGG
CGGGATGTTGATGGGGCCAACGAGTGCCCCGGTACTGTTGATGCCCAGCCCGATGGCGGGAACAGTAATAGGCGGAACAT
TGATCGGCCCCACCAACGCTCCGGAACTGTTAATGCCCAGGCCGATTTCGGGAATGGTGATGGACGGGATGGTGATGGGG
CCGACGGAGCCGAGGCCGTTGAGGTCTAGGCCAGCAGCGGGAATGGTCAGTGTGCCGGAGAAGCCGATCAAGCCCTGGTA
GTCGCCTCGCCAGAAGAAGCCGTTGCTGTAGTTGCCAGAGTTGAATCCACCGGTGTTGACGTTGCCGGTGTTTCCCACGC
CGGTGTTGAGGTTGCCGGGGTTGAAGAAGCCTGTGTTGGAGCTGCCCGTGTTGAAGTCGCCCGTGTTGAAGCTGCCTAGA
TTGAAGCTGCCCGTGTTGTAGTTGCCCGTGTTGCCGATGCCAGTGTTGGCGATGCCGGCGTTGAAGAAGCCCGTGTTGGC
TTGGCCCGTGTTGCCGATACCCGTGTTGTAGCTGGTACCTGAGTTCCCGATGCCGAAGTTTCCGGTGCCCGTATTGCCGA
TGCCGATGTTGCCGGTGCCTGAGTTGAACAAGCCGATATTGCCGGTCCCCGAGTTCCAGCCGCCGAACCCTGCTGGTTG
TCGCCGGTGAGGCCGAAGCCGATGTTTCCGTTGCCCGTGTTGCCGAAGCCGATGTTTCCGTTGCCGGTGTTGCCCAAGCC
AACGTTGTTGCTGCCGACATTTCCAAGGCCGAAGTTGTTGCCGCCGGGATTTGCCGCCAAGTTCAAAATGCCAAGGT
TAGCGGCGCCCATCTGTCCGAAGCCCGAGTTTGCCAGGCCTAAGCTAAGATTTGCCAGCACACCCTTGGAACTGGTGATC
GCCGCGGTGACGACGGCCGCCGGAGCGGCCGCCAACTGGGCGGGCAGGTCTGTCAGATTCTGCGGCGGCGCAGTGAACGG
CGTCAGGGCCGACGCCACCGCCGATGCCCCGGCATGGTAGGCCGACATCACCGACACATCGATGGCCCACATCTGTTCGT
ATGCGGCCTCAATCGCAGCGATCGCCGGAGCATTCTGCCCGAAGAAGTTTGAGAACACCAATGACACCAGGTCGGAGCGG
TTGGCCGCCACCAGCGCCGGTTGCACCATCGCCGCCCGGACAGCCTCGAACTCGGCCACGAGGGCCGCGGCTTGGGTTGC
CGACCGCTGGGCCTGGGCCGCTGCCGCGGCAAGCCATCCTAGGTACGGCGCTACCGCAGCGGCCATCGCCGCCGATGACG
GTCCGAGCCACGATTCGCCGACCAGGCCCGACGTCACGGAGTTGAAAGAGGCCGCTGCCGAGGCCAATTCCATCGCCAGT
TGGTCCCAGGCGACCGCGGCCGCCGACATGGGTTCTGATCCCGCCCCGCCGAATATGAGGGCCGAGTTGATCTCTGGTGG
CAATGTTGAAAAATTCATGGCCCCGACTTTCCCTGGGTGCACCGAATTCATGGCGGCTCACCAACCCGCGGTCGGCGAGC
GCCGTGTCGCTCGACGCTACTCGGCGATCTTCGCGGCCGTATGCATATCACCCGAATAGGGCCATGATTCATAGATCTCG
TCAAACTGATTTACGGCGGGCGCTTTTTAGCCGCTTTAGGAATCGACGCCAAACCCAACGAACGAGCCTCAGCCAAGGCC
GAAATCGATTAATTCCCCGATGATTTCATCGTTGTGGAGGTCGTCGCAGGCGTCGTTGATCTGATCGTGGCGATTACGGC
TGGTGATCCTCTCCGCGGGCGGGGTCCGCACGGATTATGGCGTGGTGCTCTGGAAGAACAGGCCCGACAGGTTGTTGCC
GATGTTGGCCAAACCGGAGACCAAGCTGGTCACGGCAAACGGCAGGGTGCCGGTGTTGGCGAAGCCGATATGCCGCTGC
CAAGGTTGGAGAAGCCGGAGATAAGACCACCGTAGTTCTGGTAGCCCGAGCCGGCTAGCAGCCCAACAGGACTTGTGTTG
AACCAACCCGACAGTCCCGAGCCGCTGTTGCCGAAGCCCGAGTTCCCACCGATTCCGGCGTTGAAAAAGCCCAACGAGGG
CGTTGCGCTCGAGTTGAAGTATCCCGGCCCCGCTGGGATTGCGAATCCGCCCATGGTGGTGCTCGGCAGGTGGATGCTGG
CGATGGTGAGTGCGGGTGTGGTGAAGGCCGCCAAGCCCACCGGCTGGATGGTGAACTCTGGCGTGGTGATCTCCGGGATA
TTGACCTGGGGGAGGGTGAAACCGCTAAGTCCGATCGGGTCGATGGCGAACGGTGGAGTCGTTATCTCGGGCGTCATGAT
CTGAGGAAGCGTGAAACCACCCAGCGCTATCGGATCGATCGTGAACGCCGGGGTGGTAATCGCCGGGATGCTGAGCTGCG
GCAGCGTAAACCCACCCAGCGTGATCGGGTCGATGGTCAACTCCGGGGTCGTGAACTGTTGAGTAGTGATATCCGGCAGG
CTCAATGCACCGACACCAATCGGACTGATCGTCAACGCCGGAGTGGTGAATTCTTGGGTGCTGATCTCTGGCAGGGTGAA
CCCGTCGACCGAGATCCCCCCGAGGGACCACGGTTGGATGACGACGTTGGGGAGGGTGAAGGGGGTGACGTTGATTGCGC
CGATCGAGAAGCCGACGCCGTTGATTTGACCTCCACCCACGGTAATGGTCCCAGTATTAATAAAGGCAGGAGGTGTATTA
GCGAAGCCGCCAATCTGCGGGAATACCCCGGGCATATTGGTTTGCAAGGCAGTGATGTTGTTCGGAATGAACACCACCAA
ATTAGTTATCGTAATGCCGTTAAGGCTAAAGGTGGGAAGATTGATGACACCAGAATTTGCTTGCGTGGCTATGCCGGGAG
TGCTAAAGCCGCCTATACTTATTTGGGGTGTACTTATTAACGGGGTGTGTATCGTGGGTAGCGTAAATCCGGACAGTG
GTGCCAGCCGGAATCGTGATCGGCGGAACCGTCACCGACGGAATACTCAGCGTCGGCAGATTGAACGCACCTAGCGCTGT
GCCAGCCGGAATCGTGATCGGCGGAACCGTCACCGACGGAATACTCAACTGAGGCAAGTTAAACGCACCTACCGTGATGT
TGGCTGGTGTCGTTGTAGCTGGAATCGTCAACGACGGCACCGTCAACCCCGGCAAATCAAACGCACCCACCGTGATGTTA
GCTGGCGTCATCGCCGCTGGAATCGTCAACGACGGCACCGTCAACCCCGGCAAATCAAACGCACCCACCGGTAACGTTGGC
CGGCGTCGTCACCGCCGGAATCGTCAACGACGGCAAGGTTATCGCGGGCAGGCTGAACGCGGGAACCGAGATTCCGGGTA
TTTCCAGAGACGGAAGCGTCAAATCAGGGCTGGTGATGGCGAACTGCAGGCTGCCTTGGCCCACACCACGGTAAAAGACA
CCATTGTTCATGTCGCCCGTGTTGAACAAGCCGTTATTCATGTCGCCTATGTTGAAGGCGCCGGTGTTGATGCTTCCTGT
```

FIGURE 4(continued)

```
GTTGAACCAGCCGGTGTTGGCGCCGCCCGTGTTGAAGGTACCCGTGTTCGACGGGCCCGGGTTGAAGGCACCGAAGTTGT
AGTGGCCGACGTTGAAGCTGCCGGTGTTCGCGTTCCCAACGTCGAACATGCCCGTATTGAAAGAGCCCGCATTCAGGAAT
CCGGTGTTGCCGTGTCCGGGGTTGAACAGGCCAGTGCTGAAGTTACCGGAGTTCCCGATGCCAAAGTTGCCATTGCCGGA
GTTGAAGAAACCGATATTGGCGCTACCCGCGTTGAATAATCCGACGTTACCGTTGCCGGAATTGAGTCCGCCAATGCCGA
TTTGGTTGTTTCCAGTCAGGCCGTTGCCGATATTGTTGTTGCCGGTGTTCGCAATTCCGAAGTTGCCGATGCCTGCATTG
GCGAATCCCGTGTTCAAATTGCCCAGGTTTGCAAGTCCGAAGTTGTTGGCGCCCGCGTTTCCTATGCCGATGTTGTTGCC
ACCTAGGTTGGCCGAGCCGATATTGAAGCTACCGAAGTTGCCGGACCCCAGATTGTTGTTGCCAAGGTTGGCGTTGCCGA
TGTTGCCGAGCCCATTGTTGGCATTGCCGAGGTTGCCACCACCGACGTTGGCCAAGCCGAGGCTAGCGGCGATCGCCCGG
CCGGCAAAAGTCGGCATGCCCACGGCCGTGGTGAGCGCGGTCACCACGGCCGCGGGCCCGGCCGCCAGACCCGCCGGAAG
CCGCAGCGGGAGGGCGAATGCCGGTAGCGCCACAGCGACCGCCGACGCCCCGGAATGGTAGGCCGCCATCGCCGATACAT
CCAGAGCCCACATCTCCTCGTATGCGGCTTCGGCGGCCGCGATCGCGGGAGCGTTTTGACCAAAAAGGTTCGATATCACC
AGCGATATGAGGCCGGAACGGTTGGCGGCCACCAGCGCCGGTTGTACCATCGCCAGCCGCACAGCCTCGAACTCGGCCAC
CATCACCTGGGCCTGGGTGGCCGCCTGCTCGGCCTGGGTCGCCGCCGCGGCCAGCCACCCCGCATACGGGGCTGCCGCCG
CTGCCATCGCCACCGATGACCGACCCTGCCACGACCCGCCGACCAGCCCGGCTGTCACCGAGCCGAAAGAGACAGCAGCC
GAGGCTAATTCGGTTGCCAGCCCGTCCCAGGCCGACGCCGCCGCCAGCATCGGTCCGGAGCCCGCCCCGGCGAAGATCAA
GGCCGAGTTGATCTCCGGCGGCAACACTGAGTAATGCATCGCTCCCCACCTTCCGGGGTGAGCCTGGTGCTGATGAAAGG
TCACACGCCCGTCGTCGCTGACTCGTTCGTAGCGCATGAGAGTACGCGGAGATCTTGAATTGTGTATCCGAGCAAATGAA
ACCGTTATCTATTTGTTATAGACATATCGGGCACGGATGCAAAGTTCTTTTACACGCTATGCGTAATCACGATCCGTGCC
CGTCTGATGTAAACCACCGACGTAGGCGCACTGATATAAATGCATTTATTACCAAGGTGATTGGGTGAAATAATTACCCC
GGAAAACTGTGCTCAATAGGAACGATTATTAGTTTGAATCACTGCCATAATCCACCCTATGTGCAACCCGGATGAATTCC
GATCGCGTGCTTATTCCTGCCAAACATTCGGGCTTTAGCCCTGGCCCACCACGCGGGCACCAATCCGACGCTGCCCCTAC
AGCGAAATCACCGGCGCACCGCCTCCCGCTCGGCCGCCTTCACCAGTTGACCCGCGAAGAACCTGACCGCGCCACCCAGC
GCCGCCCGCATCACCGGCCCCGTCCCACGAACCTTTTCGGTAAACGAGCCACTCCAGCGGAGATCGGTACCGCCCGACGC
ATTTGGTGTAAGGACCACCTCGCCGAAGTAGTCCTGGACGGGTGTCCTCGCGCCAACCAGCTTGTAGACGTGGCGACGGT
CCTGCTCATACTCGACGGTCTCTTCCTGCACGAACACCGGCCACATGCCTAGTTTGCGGATGGCCCCGATGCCGCCGGGC
GCGGGATCACCGCGTCGCGCCCAACTCGATTGAGCAACGATGGGCTTGGCCCAGGTCGCCCAGTTGCCACCGTCTGTCAC
GAGCCGAAACAAGGTTGCAGCCGGCGCGCTGCTGGTCTTGGTGACCTCGAACGAAAATTTCCGACCCGACATGCGCGACT
CCCGAAACGACAACTGAAGCGGCCCGATATGGTGCTGCCGCGTACCCTACCGCGCAGCCGTCCGTGCCGGCCGTAGTGGA
CCAGCCAAGGTGTTCCCGCGCTGGCCGCAGCAGGCGCATAATCACGAGGTGTCCCGCGCAGATACCGTCTCAGTGCCCCG
TGCGCCCACCCAGGCTGAGGTCGCCGCAGTGCTGCGCATCATGACGCCGCTGCGCAAGGTGATTAAACCAAAGGTCTATG
GGATCGAAATGTGCCGACCGAACGCGCATTGCTGGTTGGCAACCACAACACGCTTGGCTTGGTCGACGCGCCATTGCTG
GCCGCCGAGCTCTGGGAGCGGGGAGAATCGTCCGGTCCCTTGGCGACCACGCCCATTTCAAGATTCCGGGGTGGCGCGA
CGCGCTGACACGAACAGGGGTCGTCGAAGGCACCAGAGAGATCACCTCGGAGTTGATGCGACGCGGCGAGCTCGTCATGG
TCTTTCCCGGCGGCGCCCGTGAGGTCAACAAGCGCAAGAACGCAGTCGACTTGATCGGGGATTGGGGTGCCGTCGTTGCGCA
GCGCGCTTGGCAATTCAGCACGCTATCCGATTGTGCCGTTCGCTTCGGTGGGTGCTGAACACGGCATCGACATCGTGCT
CGACAACGAATCCCCACTGCTGGCACCGGTCCAGTTCCTCGCCGAGAAGCTGCTCGGCACCAAAGACGGTCCGGCGCTGG
TCCGTGGTGTCGGACTGACACCGGTACCGCGCCCCGAACGGCAGTATTACTGGTTCGGCGAGCCAATCGACACCACAGAG
TTTATGGGGCAGCAAGCCGACGATAACGCCGCACGCAGGGTGCGCGAGCGTGCCGCCGCCGCTATCGAACACGGCATCGA
GCTGATGCTGGCCGAGCGCGCAGCCGATCCAAATCGATCCCTGGTCGGACGGCTCTTGCGCTCGGACGCCTAAGGCGCCC
CTGAGGCGTTCCCGGGCCTGATTCAGAAGTCAGAAGACCGAGTCGACTTGATCGGGGATTGGGGTGCCGTCGTTGCGCA
ATACCGGTTGTTTCGATCCGTCGGGGTTGATGAATGCCTCCCCGCATACGTAAGGAGCGTGCTGGGGCAGCGGGTCGATA
AACATCGGGTTGATCGCCCACTTACCGCCCCTGGTGAACAGGCCGTCGTAGGCCCGGCACATGAGGTCGTCCTGGTTGCG
GTTGATCACGAGTGACACCACGGTGGCGTCGCCGACGAAGGTGGCGTCGCTGTTCGAGTCGCCGGCGGCGAGGACTTGAC
GACGATCCGCCGCGAGCTGATTGAAGGCTTGCGGGCCAGTCACCCCGAAGATGACCTGATTGGCCAACACCGTTTGCCA
TCAAGGTAGGTCATGACTGAATCGTCGCCGTCGCGGACGCCTCCGCAACCGACGAGGTGAGCGGTGAGTTTCCCGGACTG
GTCGGCGACGCTGCGGACTCCGACGCTGATCGTCTAGAACCTACCTCGCCCGCCCACACCTTGACGATCGGTTCGG
GTGACGCTGACACCACCCAGGTGTCGATACCGTGTGCCTGCAGAGTACCGATGAGGTCTTTCATTTGTGGATAGACGCGG
ATGTAACCATCGACCTGCTGTGTTCCGACCTGCTGGGTGGCGCCGACATCGGCGGCAAGGTTCTGTTTCTTGGCCTGGTC
TGCGAATCCGGCGAGCTCCTCAGCGGTGTAGCCCGCCGACAGTGCGTTGCTCCACGCGTACGGACCCGCCAACCGGCGCA
CGTTGTTACCCACGAAAGCCGGCTGTCCCGTGGTGGTTTCGCCGTCGAGAAGGGAAAGGATCTCGTTCGCGCACAACGCA
TTGCTGCCGGTCGGCAGCGGCTTGCCGGCAGGTACAACCTTGCCGCATGCCACGCTCAGCGCGTTCGCCGCCGCGTCGGT
CAGGTATCGGCTGGCGGCAGCCAATCCTGGTTGGCTGGCTGCAGCACCAGGCTGTGCTGCAGCATGTAGTAGTTCGTGG
CGTAGCCGATGTCGTTCTTGACGACGGTGTTGTCCCAGTCAAAGATGGCGACCTTGCGCCGCAGAACCGTCGCGGTGCCG
GTGCACCTGCTGTTGGCATCGATCGCCGACTGCAGGAATTCACGAACTCCGTGGTGCCACTTCAGAAACGCGTCGAGCTG
ACGACAGCCGGACGCTGGGGTCGGGGTTGGTGGGCCGAGCAGCCGATGACGCCACCGAGCACGGTTGCCATTGCCAACA
GCGACGGTATGAGTCGCACCATGTAAGCCCTTCGTCAGCCCTTGGTCGTGCCAGCATGCGCCGGATGGAAGGGGGATGGG
```

FIGURE 4(continued)

```
AACTGAATGGTTGCCTGCTGAACTGAACGCTGAGCAAATTCGATGCCGACGAAACATTATGGGTTTGTTTCTCGACGGCA
ACCCGTGCGCGATTCGACAGTCACCGCGATGCTGCCGACGCCGGCCCGCGCTCCCGGGCGATCCGCGTGAGCAGCGTAAT
CTCGTGCGCACGGATTTGCGGCCCCGGACTAGCGCGAAAGATACTGTTGAACAGATGGATTCGACTGTAACGGCCTCGATC
CGACGCATGCTGGGACTGCTCGCCGCCACATTGCTGCTCGGCGGCTGCACCGGCCAGCACACGACACGCACAGCGGCGAG
CACCACATACACGCCCCACATCAAGGCCAGCAGTCAGGACGTACTGGACGGCGCCATCAATGCCGACGAGCCAGGTTGTT
CGGCCGCGGTAGGAGTCGAGGGGAAAGTTATCTGGTCAGGCGTTCGCGGCATTGCGGATCTGGCATCCGGCGCCAAGATC
ACCACGGACACCGTGTTCGACATCGCGTCGGTGTCCAAGCAGTTCACCGCCACCGCGATCCTGCTGCTCGTCGAAGCCGG
AAAGCTAACACTCGACGACCCGATATCCCAATACGTACCCGAGCTACCCGACTGGGCCCAAACCGTCACCGTCGAGCAGC
TCATGCATCAAACCAGCGGCATCCCTGATTACGTCGCATTGCTGGCAGCCAGGGGGTATCAGGTCAGCGACCGCACCATC
GAGGCCGAAGCCCGGCAGGCGTTAGCGGCCGCCCCGAGCTGCAATTCAAGCCTGGCACCAGGTTCGATTACTCCAACTC
CAACTACTTGCTGCTCGGCGAGATTGTCCACCGCGCATCGGGACAACCGCTGCCTGAGTTCCTCAGCGCCGAGATCTTTC
AACCGCTTGGTCTGGCCATGGTGGTGGATCCGGTCGGGAAGGTTCCCAACAAAGCCGTGTCATATGAGAAGGGCACTGGT
GGAAACCGGTCCGAGTACCGGGTGGGCAATCCGGCCTGGGAGCAGATCGGCGACGGTGGCATCCAGACCACGCCTAGCCA
ACTGGCCCGGTGGGCGGACAACTACCGGACAGGAAGCGTCGGCGGCCTGAAACTGCTCGAAGCACAACTTGCCGGTGCGG
TGGAAACCGAACCCGGTGGCGGCGACCGCTACGGCGCCGGAATCGTGTCGCGCGCCGACGGAACACTCGACCACGCGGGC
GCCTGGGCCGGATTCGTCACGGCATTCCACATCAGCAGTGACCGACGGACTTCGGTGGCCATCAGCTGCAACACCGACAA
GCCGGACCCGGTGGCCATGGCCGATGCGCTGGGGCGCCTTTGGATGTAGCGGGGCTACCGCGGTTGGCCGCCGGTACCCA
GGCTGCAATCATTCACGGTATGGCGCAACCACCGTCACTCCTCACAACTGACAATGGCCTACCCTTCGGCGTGCAAGGTG
CCTGCGACTCCCGTTTCACCGGAGTCATCCGTGCCTTTGCTGGGCTGTACCCCGGCCGCAAGTTCGGGGGTGGGCACTG
TCGGTTTATATCGACGGTCGCCAGGTCGTCGATGTCTGGACGGGGTGGTCCGATCGGCAGGGCAAAGTACCCTGGACGGC
CGATACCGGGGCAATGGTGTTCTCCGCGACCAAAGGGTTGGCCGCAACGGTGATTCACCGTTTGGTCGATCGCGGCCTTT
TGTCCTACGACGCGCCGGTCGCGGAGTACTGGCCCGAGTTCGGAGCTAACGGCAAGTCTGAGGTCACCGTCAGCGATGTG
TTGCGACATCGGTCCGGACTGGCGCACCTCAAGGGGGTGGACAAGGACGAGGTCATGGACCACCTCCTGATGGAGCAGAA
GTTGGCGGCTGCGCCGCTAGACCGCCAGCACGGGAAGTTGGCTTACCATGCGGTGACTTACGGATGGCTGCTGTCCGGCT
TGGCTCGTGCAGTGACCGGCAAAGGCATGCGTGAACTGTTCCGCGAAGAACTCGCTCGCCCGCTGAACACCGATGGTATT
CATCTCGGCCGGCCACCGGCCGACTCGCCTACCAAGGCGGCACAGACACTTCTGCCCCAAGCCAAGGTCCCCACCCCACT
GCTCGATTTCATCGCACCAAAGGTTGCGGGGCTGTCGTTCTCCGGGCTGCTCGGCGCCGTCTACTTCCCGGGCATCCTGT
CGTTGCTGCAAGACGATATGCCGTTCCTCGACGGTGAGGTTCCGGCGGTCAACGGCGTTGTGACCGCGCCGCCCTGGCC
AAGACGTATGGGCGTTGGCCAATGACGGTGTGATCGACGGCACCCGACTGCTGTCGTCGCAGGCGGTACGTGGATTGAC
GGGGAAGTCCGAGCTATGGCCGGACCTTAATCTCGGTCTTCCTTTTACCTACCACCAGGGTTACCAATCGTCTCCGGTGC
CTGGGCTGCTGGAGGGGTACGGCCACATCGGGCTCGGTGGCACGATCGGATGGGCCGACCCGGAGACCGGCAGCGCATTC
GGATATGTGCATAACCGCTTGCTGACGCTACTGTTGTTCGATATTGGCTCGTTCGCAGGGCTGGCTGCGCTGCTGAACAG
CGCCGTCGTGGCAGCACGTCGCGATGACCCCCTGGAAGTGCCGCATTTCGGTGCGCCCTATAGCGAACCGCGTCATGAGC
AGGCGGCCTCGGGTGCATAACTGCTCCCGTTATGCCGCGAGCGCGAGCCCGACGGGCTAGAACTCGTAAACGAGTAGCCA
GACGAGAGCGACGGCCGCCAAGAACAGACCAACCAGGATAGCCTGCGGGTAACCAGTACCTGGCGATGGAACCACTCTC
GCAGCTGGGTGAATCGCCAGTCGGTCCAGGCGTAGGCGCGCACAGCCCACTGCCCTCGACCGCGAGCAGTCGAAACGCG
ACCAGCAGGGCCGGGATGCCGAGTTCGGGGAGCAGCACGATCATCGGCAGGGATACGACGAATAGCCCGCCACCGACCAC
AGCGAGTGTCGCGCGAATCAGTAGCGGCCTGGCCCGTACCCGCTGTCGGTATGCGAGCACTCGGGCGAGCGCGGCGTCGC
GGGTGGAAGTCGGGTTGATGACGTCGGCCGGGTCCATGACTGCTCCTAGTGTGCCTGCCTCGACGCCTAGCGGACGGCTG
TGTCGGGGGTGGTTTGGTTCGGACTCTAGTGGAGCCCGGTTGCGCACTCGGGTCCGACCAATGCGGGGCCGCGCCTCATA
CGCACGATAAGCGTGGGTGTATAGACTGCGGTTATGAATGACGGCTCCCGGCCAGGAACTCAGGGTTCGTAGCGGCCTACT
ACAAATCGAGGACTGCCTGGATGCTGACGGCGGCATCGCATTGCCGGCAGGCACCACGCCTGATCTCGCTCATCGAGCGCA
ACATCAAGTATGTCGGCGACCTCGTGGCGTATCGCTACCTGGACCACGCCCGTTCGGCCGCCGGATGCGCCCTGGAAGTG
ACCTGGACGCAATTCGGTATGCGATTAGCGGCCATAGGTGCACACGTGCAACGGTTCGCAGGCCCCGGCGACCGCGTTGC
GATCCTCGCACCACAGGGCATCGACTATGTTTGCGGGTTCTACGCTGCAATCAAGGCAGGCACCGTCGCGGTGCCGTTGT
TCGCACCCGAACTGCCGGGTCACGCCGAGCGTCTTGATACGGCACTTCGCGATTCGGAGCCAGCGGTCATACTCACGACG
GCGGCGGCGAAAACGCCGTTGAAGGTTTTCTGAACAACGTTCCGCGCCTGCGAAAGCCGACAGTCCTCGTCATCGATCA
AATACCCGACCGCGAGGGGGAGCTGTTCGTCCCGGTCGAGATGGACATCGACGCCGTATCCCACCTGCAGTACACCTCGG
GCTCGACGCGACCCCCGGTCGGTGTCGAGATCACCCACCGCGCGGTCGGCACCAACCTGGTGCAAATGATCCTGTCGATC
GACCTGCTCAACCGAAACACCCACGGCGTCAGTTGGTTACCGCTGTACCACGACATGGGCCTATCCATGATCGGCTTTCC
GGCGGTCTATGGCGGACACTCCACCCTGATGTCGCCCACGGCGTTTGTCCGCAGGCCACTGCGATGGATCCAGGCGTTGT
CCGAGGGGTCGCGGACCGGACGCGTGGTCACCGCGGCGCCAAACTTCGCCTACGAGTGGGCCGCACAGCGTGGACTACCC
GCGCAAGGCGACGACGTCGACCTCAGCAATGTCGTGCTGATCATCGGTTCCGAACCAGTCAGCATCGATGCGGTGACCAC
GTTCAACAAAGCGTTCGCGCCCTATGGTTTACCGCGTACAGCGTTCAAACCCTCGTACGGCATAGCCGAGGCGACCCTGC
TCGTCGCGACCATCGACCATGCCGCTGAGCCGACGGTTGTTTATCTTGACCCAGAGCAGTTGGGCGCCGGACACGCGACG
CGCGTCGCGCCGGATGCGCCCAACGCCGTCGTGCACGTGTCGTGTGGCCATGTGGCCCGCAGCCTGTGGGCCGTGATCGT
```

FIGURE 4(continued)

```
CGACCCGGATACCGGCCCCGAGGCGGGCGCCGAACTGCCCGACGGTGAGATCGGTGAGGTTTGGTTACAAGGCGACAACG
TTGCTCGGGGGTATTGGGGACGGCCGGAAGAAACGCGGATGACGTTCGGTGCCCGCTTGCAATCACCGCTCGCCGAAGGC
AGCCACGCCGACGGGTCCGCGATCGACGACACCTGGCTGCGCACCGGAGACCTCGGCGTGTACCTCGACGGTGAGCTCTA
CATCACCGGTCGAATCGCGGATCTGCTGACCATCGACGGCCGCAACCACTATCCGCAGGACATCGAGGCCACGGCCGCCG
AGGCCTCGCCGATGGTGCGGCGCGGATACATAACCGCTTTCACGGTGCCGGCCAGCGACGGGACGACCGCAATCAGCGA
CTGGTGATCATCGCCGAACGTGCGGCAGGCACCAGTCGCAGCGACCCGCGGCCGGCGCTCGACGCGATTCGCGCAGCGGT
TTGCAACCGCCACGGGTTATCCGTTGCGGACCTGAGTTTCCTGCCGGCCGGCGCCATTCCACGCACCACCAGCGGGAAGC
TGGCTCGCCAGGCCTGCCGCGCCCAATACCTCAGCGGTCGCCTGGGCGTGCATTAGCTACGATCTACGGCTCCCAAATCA
GCAGATCCTCCATGCCGTTGTTCATCGCGACGATGGTTGGCGATGGGCCGGTGACATCGAAGTAGATTTTGCCGGTCGAT
TGTTCGCCTTGGGGGATAGTGGCTCCGCTAATGGTGTCGGGGCCCGCGGCTTGCCACAGCACCCGGTAGTTGATGCCGTC
GGCGGTGCGGGCATTGAACTGCGAGACCGCGGGCGTGACGCTGCCGCGAATCGCATTGACCGTGGCAGTGGCCTCCCAGA
CCTGGCCGGCCACCGGATAGCCGGGGATGACTGCCGTGCTGGATTTGAGATCACTGACCTTCCAGCCGAGCACGACTTGG
CCAACGGTGTCGGTCATCGTTAGCTCACTGCCAAGTTTTCCGGTGATGGGATAGGCAGCCAACGCGACCGGTGCCGCAAA
GGTCGCGATGGCCGCCATGGCCACGACCGCTACTGCCGTCTTGATCATTGTGGTGAGCTTCATTGGTCCCTACCTCCACT
ACTTGTTGGGGCGATTACCTGGTTCGAACCTCGCCGACGTCATTACCTTAAGCCGCAAATGACCCGCTGCTAACTCCAGA
TTCGATAGGAACCGTGGGCAGACGATGCCGTTCACATCCGTAGCCGGCGCACCGACGACGGGCGTGGCCATGAATGCTT
GATGGCCGAGTCGTAGGCGACCAGCGCAAGGGAGCCAAACCGCATGTCAGGATGGTGTGGTGACCGCCATACCCGGCCCG
TCGGGCGCCGAACCCGGTGAGAGCCGCGCGCTCGCGGGTTACCCGGTGACGCCGCCGGCGCTGCCCCGCCCGGTGATCTT
CGACCAGCGCTGGACTGACCTGACCTTCATCCACTGGCCGGTGCTGCCGGAGAGCGTGGCAGGCAGCTACCCGCCCGGGA
CTCGCCCCGATGTCTTCGCCGATGGGATGACTTACGTGGGTCTGGTCCCGTTTCGCATGAGCAGCACCAAACTCGGCACC
GCACTGCCGATCCCGTATGTCGGCACCTTCCCGGAGACCAATGTCCGGTTGTACTCCATTGATAACGCCGGCCGGCACGG
GGTGCTTTTCCGGTCGCTGGAAACAGCTCGACTGACTGTCGTACCGCTCACGCGGATAGGACTCGGCATCCCGTACGCCT
GGTCGAGGATGCGGATGATGCGCTCTGGTAAGCACATTACGTATCACAGTGTCCGCCGCTGGCCACGGCGCGGACTGCGC
AGCCTATTGACGATCACCATCGGTGACCTGGTTGAGCCGACGCCGCTCGGAAGTCTGGCTTACCGCACGGTGGGGTGCGCA
TACCCGCAAGGCTGGCCGGACTTGGTGGGTGCCGAACGAGCATAAGCCGTGGCCGTTGCGGGCCGCGGAGATCGCCGAGT
TGAACGACGAGTTGATCGACGCAAGTGGCGTGCAACCCACTGGCGATCGGTTGCGCGCCCTGTTTTCACCGGGTGTGCAT
GCCCGATTCGGCCGTCCGTGTGTCGTTCAGTGACGTTTAGGGGCAGGTGTATCCACCATCAATCACGATGTCGGAACCGG
TCATATAGCTGGAAGCCTCGCTAGCCAGATACAGGTAGAGGCCAGCGAGTTCTTCGGGCCGGCCCAACCGGCCCAACGGA
ATCTTGGGCTCCCATAGCGGCTGGTATTCCGTGTACGGTTCGACGAGCTCGGTCAGGATATAGCCCGGACTGACACTGTT
CACCCGGATTTTATGCGGCGCCAACTCCACGGCCATGGCTTTGGTTAGATGAATGACCGCCGCCTTGGAGGCGCAGTAGT
GGGAAACCTGCTGCGGGACGTTGATGATGTGGCCTGACATGGAAGCAGTGTTGATGATGACCCGCCTTGGCCTTGTTTG
ACCATCGCCTTGGCAGCGGCCTGCGCGGTAAGGAAGACGCCTGTCACATTGGTGTTTTGGAGGCGCTGGAACTCTTCCAG
CGGCATGTCCAGCATCGGAGTGACCGTGATGATGCCGGCGTTGCAGACCGCGATGTCGATCCCACCCAGCTCCGCGGTCA
CCTGATCCAACATGCTGGTCACCTGCTGGTGCTGGCTCACATCGCAGCAGACGGGCACGACCTTGCCACCTGATGTGCCA
ATCTCATCCGCCAACTTCTCTAAGGCATCCAAATGCCGTGCGCGCATCGCCACTTGAGCCCCGGCTTCGACGTATGCCAG
GGCAACTCTCTTGCCGATGCCGGTGGATGCCCCGGTTATCAGCGCCCTCTTGCCGTGCAAGTCGAACAGGTCCAACACGC
TCATTCGTGATCCCCTTTCGCGCGACGCAGGGCCGATACCTGATGGAATCACATGCCGAAATGCGTTCGATGAACTGCCG
CAATGGCTTCCAGTGGTCCGCTCACTTCGACCCGCGCTACGGCTCGGCGTCCAAAGACGTACAGCAGCAACTCGCCGGGC
GGTCCGGTCAGGCGAGCCGTCGGCTCGCCTGACCGGACCCTCACCCGCTTACCGGTTCCAACCCACTCGATCTCAAGCCC
GCAACCGTGCAGCCGCCGACTCAGGAAGTGGCTGCCGCGCCGAACATTTCGCCATAGGGCAGCATCCATTTCGGGCGTGA
GGCTTCGGGGCCCTCGTCCGCTGGCGCGGCGAAGTCCTCGTGATGGACAAAGAATTCGTTGAGGTTCGCCAAGGTACGA
ACCCATCGGATGCGGAAGAACCCCATCGGTGGACCGGACCGAATCCGAGCGACGAGCCACGTGAAGTCTTTACTCTGAGC
CAATCTCGCTCTACGGCGTTCGGCAAACCGCTGGAAGGGACCCGGTAGAACGATGCAAAGGCCAGCAACGAGATCGCGTT
CACGCAGCACGATGTGAGCGGCCAGGTCGTGAGCAGTCCAGCCCTCGATCAGTGTAGCAACCGCAGGACCGAGCTCCTCA
AGGAGATCACAGAGCTCCAAGCGTTCTTGCGCGTCCAACGGGACATCAGCCACGCCGCGGGAGTCTACGGGCGACGTGCC
TGCGCGCCAACGGGCTGCCGCTTGCGCCGTCGCGACTGCACAGCAGCCAGCGCCCGCTCCCAGGCGAGCAGCGTTGCGGC
CGTCAGATTGGCCGGTTTGGCGCTGTCCTTGGACAGCAGCGCGGTCGCGGCGGCTTTGGTGGTCGGCGACGCCTTCGACA
TGTGACCGGAGTCGAACGGCGGCTGCGGGTCGTACTCGATCGCCAGCTGAATCGCCTTGGCCCGGGCCTCCCCGCCCAGC
TGTCCGGCCAGCCAGAGGGCGAGATCGAGCCCGGCGGACACGCCCGCGCTCGTGACAATGTTGTCCTGGTGCACAATCCG
CTCGTCGGCGACCGGGATAGCGCCGAATGCCTTGAGCGCGGGAAGCGTCAGCCAATGCGAGGTCGCGCGCCGGCCCCGGA
GCCACACGAACCGCACCTGGGCGTGCGGCAGGTTTCGCAGCACCTCGTACGGGCCGACCACGTCCAGCGCGGTAACGCCG
GGGTAGGCCACGAATGCGATTTGCGTCATCGGTGTTCTCCCTAGTGTCAGGCGAAGGCTTTGCGGTATTGGTCGGGTGAT
ATCCCGACGCGGCGAATGAAGCTGCGGCGCATGGTTTCCGCGGTCCCGAAGCCGCATCGGGCGGCAATTGCCACCACGGT
GTCGTGGGTCTCCTCCAACTGGCGGCGCAGCCTCGGCGGATGCGTTCGACGTACCGGCCGGGCGCCTCGCGACCT
CGTCGCTGAACACCCGAGTGAAATGACGCGGGCTCATGGCCGCACGTTGAGCCAGTTCGCCGATGCGGTGCGCGCCCCG
GCTCGGCCTCGATGGCCTCCTGCACCCGGCGGATCGAGGTCCGTTTGGCGCGTGGCATCCACACCGGAGCCGCGAACTGG
```

FIGURE 4(continued)

```
GTCTGCCCACCGGGTCGGCGCAGATACAGGACGAGCCAGCGGGCAACCGTCTGGGCAATCTCGGTGCCGTGGTCGTCTTC
GACCAGTGCCAGCGCGAGGTCGATGCCGGCGGTGACTCCAGCCGCGGTCCACACCTTCTGCGAACTGCGCATGAAGATCG
GGTCGGCATCGACCCGAACGGCCGGAAATTCGCGGGCGAAATGTTCGGCAAAGGCCCAGTGCGTCGTCGCTCGGTGTCCG
TCCCAACAACCCCGCTTCGGCCGCAAGAAACGCGCCCGTGCACACGGTGACGACGCGGCGGGCGGTGCCGGAGACGGCTT
TGACCCAGTCGATGAGGGCCGGTTCGGACCGTGCGGCATCGACTCCGGCGCCACCGGGCAGGATCACGGTGTCGACGGGG
TCGCCGGGGAATCCCACGATAACCACTCTTCGCGCCATGAATGCCAGTGTTGGCCAGGCGCTGGCCTGGCGTCCACGCCA
CACACCGCACAGATTAGGACACGCCGGCGGCGCAGCCCTGCCCGAAAGACCGTGCACCGGTCTTGGCAGACTGTGCCCAT
GGCACAGATAACCCTGCGAGGAAACGCGATCAATACCGTCGGTGAGCTACCTGCTGTCGGATCCCCGGCCCCGGCCTTCA
CCCTGACCGGGGCGATCTGGGGGTGATCAGCAGCGACCAGTTCCGGGGTAAGTCCGTGTTGCTGAACATCTTTCCATCC
GTGGACACACCGGTGTGCGCGACGAGTGTGCGAACCTTCGACGAGCGTGCGGCGGCAAGTGGCGCTACCGTGCTGTGTGT
CTCGAAGGATCTGCCGTTCGCCCAGAAGCGCTTCTGCGGCGCCGAGGGCACCGAAAACGTCATGCCCGCGTCGGCATTCC
GGGACAGCTTCGGCGAGGATTACGGCGTGACCATCGCCGACGGGCCGATGGCCGGGCTGCTCGCCCGCGCAATCGTGGTG
ATCGGCGCGGACGGCAACGTCGCCTACACGGAATTGGTGCCGGAAATCGCGCAAGAACCCAACTACGAAGCGGCGCTGGC
CGCGCTGGGCGCCTAGGCTTTCACAAGCCCCGCGCGTTCGGCGAGCAGCGCACGATTTCGAGCGCTGCTCCCGAAAAGCG
CCTCGGTGGTCTTGGCCCGGCGGTAATACAGGTGCAGGTCGTGCTCCCACGTGAAGGCGATGGCACCGTGGATCTGAAGA
GCGGAGCCGGCGCATAACACAAAGGTTTCCGCGGTCTGCGCCTTCGCCAGCGGCGCGACCGTCTGGAGTTCGTCACCGTT
GGCCGCGCTCATCGCGGCGAACATCACCGTCGCCCGGGTGGCGTCGATCTCGATCATCATGTCGGCGCAGGCGTGCTTGA
CCGCCTGGAAGGAACCGATCGGTCGATCGAATTGCGTTCGCCGCCCGGCGTATTGCACCGCCAGGTCGAGGCAGGCCTCG
GCGCCGCCCAGCATCTCGGCGGCCAACAGCACCCGGGCCACGTCGAGCACCCGCTCCATATCGTCGGGCGTCCCGGCGGT
CAGCGGCTCGGCGGGGGACCCCGCCAGCCGGAGCGTGGCGACCGGACGGGTGATGTCAAACGAGGGCAACGGTGTGACGG
TCACCCCGGGGGCGTCGGCGGCCACGACGTGCAGAACGATCGACCCGTCGGCCACCGCGGGCACCACGAACAGGTCTGCG
ACGTGACCGTGCAGCACCGGGGTGCACTCGCCGGTGAGTGCGGGCCGACCGTCGCGCCGAACGGCCCGAACGGTGGTAGC
CGACGCGACGTCGTGGCCACTGACGGCGATCGTTCCGATCCGCGCCGGTAAGCAGACCGGCGAGCAGGCGCTTGCGCT
GCTCGTCGTCGCCCATGCGCAGAATCGCTTCGATCGCAAACACCGTGGCCGCAAAGGGAATTGGGGTGAGCGCCCGGCCG
AGTTCGGCAAACGCGATCGCGGTCTCGACTAAGGTGGCACCCAATCCGCCGTGCTCCGGCGGGACGTGCAGCGCGGGTAA
TTCGAGCTCGGTGCAAAGCCGTTGCCACAGCCTGCGGTCGGATCCGTCCGCGGCAGCCATCTCCCGCACGGGCGCGCCCC
GGCCAAGGAAGCCGCGCAGCGAGGCGCGGAAATCGTCTTGTTCGGTGCTGTATCGGAAGTCCACGTCAGCAGAGCACTTC
GGGCCGCGGCTCCTTGGGGAGGCCGAGCAGCCGCTCGCCGATCACGTTGCGCTGGATCTGCGAGCTGCCGGCATAGATCG
TCGCGGCCCGTGCGTAGAGCAGCTCATCCATCCAGCAGGCCGGGGAGTTTGGCGTACCCGCCTCCGGGACCAGCCGCGCA
CCGCCGTTGCCGGGCCCCGCGGGCCCAGCGCCTCGGGAGCCCCAGGATTTCGACGGCGAGATCGGTGTACCGGCGGAAATA
TTCGCTCCAGATGACCTTCGTGATCGCGGCTTCCGCGCGGGCGGCCGTCCGGTCAGGGCCAGGGTGAGGTCACGGTAGC
CCCGATACCGCATGATCTGAACCCGGGCATAGCACCACGCCAAGCCGTCTCGTACCCGTGGATCGGTGTGTAATCCGCGG
TCACGGGCCAGCTCGCACAGCCGCTGCAGGTCCCGCTCAAAATCGATGGCGGCGGTGGCGATGTGCGATCCGCGTTCGAA
GCCGAGCAGCGTCATGGCGGTCGACCAGCCGTCGCCGACCCGGCCGACGACATTGCCGGCGCTGGTGCGGGCATCGGTCA
GGAAGACCTCGCTGAACGAGGAGTGCCCGGCCGCGTTGACGATCGGCCGGACCACGACGCCGGGCTGGTCCATGGGCACC
AGCAGAAACGACAGGCCCCGGTCGTTTCGCAGCGCTGGGATCGGTCCGCGCCAGCAGGAAGATCCAGTTTGCGGTGGTGCC
GGCCGACGTCCAGATTTTGTGGCCGTTGATCACCCATTCGTCACCGTCGAGCACCCCCCTGGTGCGCACCGAGGCCAGGT
CGGAGCCGGCCTCCGGCTCGGAGAAGCCCTGGCACCACCGATGCTCGCCGCTGAGGATGCGCGGCAGGAAATGCCGCTTC
TGCGCCTCGGAACCCAGGGCGATCAGGGTGTTGCCCAGCAGGTCGATTCCGAGCAGGTCGTTTTCCGCGCGTTCGGGCGC
GCCGGCGCGGGCGAATTCCTCGGCGAGCACCACTTGTTCCATCGGGGACAGGCCACCACCCCCGTATTCCGTCGGCCAGG
ACACCGCGACCAGGCCAGCGCCGGCCAGGGCCCGCCGCCAGTGCCGGGCGAACTCTTCCCGCTCGTGGGCGGCAGCGCC
CCGGGTCCGGGCCACCCGGGCGGCAGGTGCTCGGCCACAAACTCCCGGATCCGGTCGCGGAACGCTTCCGCTTCGGGTGG
GTAGCTGACGTCCACTGCGCGCCCCGGCCTCAGGGCCGCTGCTTGATCGCGGGCCGGATCTGCGGTGCGGCGCCAGTC
CTCCAGGCCGTACTCGACCGTTCCGTAGGACAGCTTGCCGCCGGTGACTTCGCCCCAGTGCGCGTGATTGAGCTGGTGGA
TCTTGAAGCAACCGTCCAGCGCGGCGGAAAACCCCATGGCATCGACGGTTTGGTTCACCGATTCCTTGATCAGCAGTGCC
GCCATCGTCGGCACCTTCGCGATCCGACGCGCGAATTCGATTGTGCTGGTCGCGAGTTCGTCAGCGGGAAACACCTTGCT
GACCATCCCCAGCGCGTGGGCCTCGTCGGCGCCTATGCAGTCGCCGGTGAGCAGCAGTTCCTTGGTCTTGCGCGGCCCGA
ACTCCCACGGATGTCCGAAGTACTCGACCCCGCACATGCCCAGCCGGGTGCCGACCACATCGGCGAACACGGTGTCCTCG
CTGGCGACGATCAGATCGCAGCACCAGGCCAGCATCAACCCCGCCGACAGCACGGCCCCGTGCACCTGGGCGATGGTGAT
CTTGCGCAGGTTGCGCCACCGCTTGGTGTTTTCGAAGTAGTAGTGCCACTCCTGGCGGTTGCGTGACTCGACCCCGCCGA
AGGTCGCCCCGTTGCACCGGTAGCTGGGGTGCTGGTCCGGCCCGGGCGAGCGTTCCCGGATATCGTCAGCGGATCCGAGG
TCGTGACCGGCGGAGAAGGCGGGGCCGGCGGCCCGCAGGATCACCACCCGGACGGTGTCGTCCGCCTCGGCAAGTTCGAA
GGCGGCGCCCAGCTCGACCAGCATGCCGCGGGTCTGGGCGTTGCGTTGTTTCGGGCGGTCCAGGGTGATCGCGGCGATGC
GCCCATCGTCGATGGTTTCGTAGCGGATGTATTCGAACTCCCGGGGCCGTCGGGAGCGTTCCCGTCCGACCGGCGATCG
ACCGGACCGACCCTGCCGACGAACATGTCCGCTCCTTACTGGACGTGAACGGCTGACCTGTGCGAGGTTACCCGTCCCTT
AGCCAACATGTCCATAGCCAATACGCACATGAGAGTGATCGATATAGACAAATTCCCATGCAAAGAAGCACTTGTGTACA
```

FIGURE 4(continued)

```
ACGAAGTATCTTGGTAGTACTGTGATATACGCAAAGGGCGCCACCGCAGCGCGCCGGGCATCCGACCGGTACAACCAGGA
AGGGTTGACGATGGAGATCGGAATATTCCTCATGCCGGCCCATCCACCGGAGCGCACCCTCTACGACGCCACCCGGTGGG
ATCTGGACGTCATCGAGCTGGCCGATCAACTCGGCTACGTGGAGGCCTGGGTCGGCGAACACTTCACCGTGCCGTGGGAG
CCGATCTGCGCCCCCGATCTGCTGTTGGCGCAGGCGCTGCTGCGCACCCAACAGATCAAGCTCGCCCCGGGTGCGCACTT
GTTGCCCTACCATCATCCGGTCGAGTTGGCCCACCGGGTGGCCTATTTCGACCACCTCGCCCAGGGTCGGTTCATGCTCG
GCGTGGGCGCCAGCGGCATCCCGGGTGACTGGGCGCTGTATGACGTGGACGGCAAGAACGGCGAGCATCGCGAAATGACC
CGGGAAGCGCTGGAGATCATGCTGCGCATCTGGACCGAGGACGAGCCCTGGGAGCATCGCGAAAGTACTGGAACGCCAA
CGGAATCGCGCCGATGTTCGAGGGTCTGATGAGGCGCCACATCAAGCCGTACCAGAAGCCCCACCCGCCCATCGGCGTCA
CCGGGTTCAGCGCCGGCTCGGAGACCCTCAAGCTCGCCGGCGAACGGGGTTACATCCCCATGAGTCTGGACCTCAACACC
GAATACGTCGCCACCCACTGGGACGCGGTGGAGGAAGGCGCGCTGCGCAGCGGGCGAACCCCGGATCGCCGCGATTGGCG
GCTGGTGCGGGAGGTGCTGGTGGCCGAGACCGATGAGCAGGCGTTCCGGTATGCCGTGGACGGCACGATGGGACGCGCCA
TGCGTGAGTATGTGCTGCCGACGTTTCGGATGTTCGGCATGACCAAGTTCTACAAACACAATCCGTCGGTGCCCGACGAC
GAGGTGACACCGGAGTATCTCGCCGAGAACACCTTCGTGGTCGGCTCGGTGCAGACCGTGGTCGACAAGCTCGAGGCCAC
CTACGACCAGGTCGGCGGGTTCGGCCACCTGCTGATCCTCGGGTTCGACTACAGCGATAACCCGGGCCCGTGGAAGGAGT
CGTTGCGGCTGCTGGCCCACGAGGTCATGCCCAGACTCAACGCCCGCCTCGCCACCAAGCCCGCCACCGCGGTGGTGTAG
CCATGGCGGTTCGTCAGGTCACCGTCGGCTATTCGGACGGCACGCACAAGACGATGCCGGTGCGGTGCGACCAGACGGTC
CTGGATGCCGCCGAGGAACACGGCGTGGCCATCGTCAACGAATGCCAAAGCGGGATATGTGGCACCTGCTGGCCACCTG
CACCGCCGGCCGCTACCAGATGGGACGCACCGAGGGACTGTCCGATGTCGAGCGGGCGGCGCGAAAGATCCTCACCTGCC
AGACGTTTGTTACCTCCGATTGCCGGATCGAGCTGCAGTATCCGGTCGACGACAACGCCGCCCTGCTGGTCACCGGTGAC
GGTGTGGTGACCGCGGTCGAGTTGGTGTCGCCCAGCACCGCCATCCTGCGGGTGGACACCTCTGGCATGGCCGGCGCGCT
GAGATACCGGGCCGGCCAGTTCGCCCAATTGCAGGTTCCCGGTACCAACGTATGGCGCAACTACTCCTACGCCCATCCGG
CCGACGGCCGCGGTGAGTGCGAGTTCATCATCAGGTTGCTGCCGGACGGCGTGATGTCGAATTATCTTCGCGACCGCGCC
CAGCCCGGTGACCATATCGCGCTGCGCTGCAGCAAGGGCAGCTTTTATCTGCGCCCGATCGTGCGACCGGTGATCCTGGT
CGCCGGAGGAACCGGCCTGTCAGCGATCCTGGCGATGGCCCAGAGCCTGGATGCCGATGTCGCTCACCCGGTCTACCTGC
TCTACGGGTCGAGCGCACCGAAGACCTGTGCAAGCTCGACGAACTCACCGAGCTGCGCCGCCGCGTTGGCCGCCTGGAG
GTGCACGTCGTCGTCGCTCGCCCGGACCCCGACTGGGATGGGCGCACCGGGCTGGTCACCGACCTGCTCGACGAGCGGAT
GCTGGCGAGCGGTGACGCCGACGTGTATCTGTGCGGTCCGGTCGCCATGGTCGACGCAGCCCGAACCTGGCTGGACCACA
ATGGCTTTCACCGTGTCGGGTTGTACTACGAGAAGTTCGTGGCCAGCGGGGCGGCGCGCCGCCGCACCCCGGCTCGGCTG
GATTACGCGGGCGTGGACATTGCCGAGGTGTGCCGCCGCGGCCGCGGCACCGCGGTGGTCATCGGCGGCAGCATCGCGGG
CATCGCGGCGGCGAAAATGCTCAGCGAGACCTTCGATCGCGTCATCGTGCTGGAGAAGGACGGCCCCGCACCGTCGCCGCG
AGGGCGCCGGGCGCGGCACAGGGTTGGCACCTGCTGACCGCCGGGCAGATCGAGCTGGAGCGCATCTTC
CCTGGCATCGTCGACGACATGGTGCGCGAGGGAGCGTTCAAGGTCGACATGGCCGCGCAGTACCGTATCCGGCTGGGCGG
CACCTGGAAGAAGCCCGGCACTAGTGACATCGAGATCGTCTGCGCGGGAAGGCCGCTGCTCGAATGGTGTGTGCGCCGCC
GGCTCGACGACGAACCGCGCATCGACTTCCGCTACGAATCGGAGGTGGCCGATCTCGCCTTCGACCGCGCCAACAATGCC
ATCGTCGGCGTCGCCGTGGACAATGGCGACGCCGACGGAGGCGACGGTTTGCAGGTGGTGCCCGCCGAGTTCGTCGTGGA
CGCGTCGGGCAAGAACACCCGCGTGCCGGAGTTCTTGGAGCGTCTCGGTGTTGGCGCTCCCGAGGCCGAGCAGGACATCA
TCAACTGCTTCTACTCCACGATGCAGCACCGGGTTCCGCCGGAGCGGCGGTGGCAGGACAAGGTCGATGGTGATCTGCTAT
GCGTACCGCCCTTTCGAGGATACCCTACGCCGCGCAGTACTACACCGACAGCTCCCGCACCATCCTGTCCACCTCACTGGT
GGCCTACAACTGCTATTCGCCGCCGCGTACCGCCCGAGAATTCCGCGCGTTCGCCGACCTGATGCCGTCCCCGGTCATCG
GGGAGAACATCGACGGGCTGGAGCCGGCATCGCCCATCTACAATTTCCGCTATCCCAACATGCTGCGGCTGCGCTACGAG
AAGAAGCGCAACCTGCCGCGGGCTTTGCTGGCGGTGGGCGATGCCTACACCAGCGCCGACCCGGTGTCGGGTCTGGGTAT
GAGCCTGGCGCTCAAGGAAGTTCGGGAGATGCAGGCGCTGCTGGCTAAATACGGCGCGGTCACCGGGATCTGCCGCGCC
GGTACTACCGGGCGATCGCCAAGATGGCCGACACGGCCTGGTTCGTGAATCGCGAGCAGAACCTGCGCTTCGACTGGATG
AAGGACGTCGACAAGAAGCGCCCGTTCTATTTCGGTGTGCTGACCTGGTACATGGACCGCGTGCTGGAGCTGGTGCATGA
CGATCTCGACGCGTACCGGGAATTCTTGGCCGTCGTCCATCTGGTCAAGCCGCCGTCGGCGCTGATGCGACCCAGGATCG
CCAGCCGCGTCCTCGGCAAATGGGCACGAACCCGATTGTCGGGCCAGAAGACGTTGATTGCCCGCAACTACGAAATCAT
CCGATACCAGCCGAACCCGCGGACCAACTTGTAAACGCTTAGGAGAGCCCAACGTGTCGCAGGTCCATCGAATCCTGAAC
TGCCGGGCACCCGCATCCATGCCGTGGCGGACAGCCCACCCGACCAACAGGGACCGTTGGTGGTGTTGCTGCACGGGTT
TCCGGAGTCCTGGTACTCGTGGCGGCATCAGATTCCCGCGCTTGCCGGCGCGGGCTACCGCGTGGTGGCCATCGACCAGC
GCGGGTATGGCCGCTCGTCGAAATACCGGGTGCAAAAGGCCTACCGCATCAAGGAATTGGTTGGCGACGTCGTGGGCGTC
CTCGACTCCTATGGTGCGGAGCAGGCTTTCGTGGTGGGCCACGACTGGGGTGCGCCGGTCGCCTGGACCTTCGCCTGGCT
GCACCCCGACCGATGCGCCGGCGTGGTGGGAATCAGCGTTCCGTTTGCCGGTCGCGGCGTGATCGGCCTGCCGGGCAGCC
CGTTCGGCGAGCGCCGTCCCAGCGACTACCACCTGGAGCTGGCCGGGCCCGGAAGGGTCTGGTATCAGGACTATTTCGCC
GTGCAGGACGGCATCATCACCGAGATCGAGGAAGACTTGCGGGGCTGGCTGCTCGGGTTGACCTACACCGTTTCCGGTGA
GGGGATGATGGCGGCGACCAAGGCGGCCGTCGACGCGGGCGTCGACCTGGAGTCCATGGACCCGATCGACGTGATCCGTG
CCGGACCGCTGTGTATGGCCGAAGGCGCGCGGCTCAAGGACGCGTTCGTCTACCCGGAGACCATGCCGGCCTGGTTCACC
```

FIGURE 4(continued)

```
GAGGCCGATCTCGATTTCTACACTGGCGAATTCGAACGTTCCGGGTTCGGCGGGCCGCTGAGCTTCTACCACAACATCGA
CAACGACTGGCACGACCTGGCCGACCAGCAAGGCAAGCCGCTCACCCCGCCGGCTCTGTTCATCGGCGGCCAGTATGACG
TCGGCACCATCTGGGGCGCGCAGGCCATCGAGCGTGCGCACGAAGTCATGCCGAACTACCGCGGCACCCACATGATCGCC
GACGTCGGACACTGGATCCAGCAGGAAGCGCCCGAAGAGACCAACCGGCTGTTGCTCGACTTCCTAGGCGGGCTGCGGCC
GTGAGCTGCACCTTCGACATGGTCCCGGAGACCGTCGATCATCTCGACGAGGTCGGCGTGCGGCGGGTCTTCGGCTGCTT
TCCGTGCGGCGTGATCGCCGTCTGCGCGATGGTCGACGACCAGCCGGTCGGCATGGCGGCCAGCTCGTTCACGTCGGTTT
CAGTTGACCCGCCGCTGGTATCGATCTGTGTGCAGAACTGTTCGACGACGTGGCCGAAGTTGCGCGACCGCCCACGGCTC
GGTGTGAGCGTGCTCGCCGAGGGGCACGACGCGGCCTGTATGAGCTGTCGCGCAAGGAAGGTAACCGGTTCGCCGGGGT
GTTCTGGAGCGAATTGTCCAGCGGGGGTGTGGTGATCGCCGGGGCCGGCGCCTGGCTGGATTGCCGCCCGTACGCGGAGA
TCCCGGCGGGGATCACCTGATCGCCCTGCTGGAGATCTGCGCGGTGCGCGCCGATCCCGAGACACCGCCGCTGGTGTTT
CACGGTAGCCGGTTCCGCCGGTTGGAGTCTCGATGAAGACGACCGATGTGCGGGTACGTCGTGCGATCACGGCGATGGCG
GGCGGTCACGCCGTGGTCCTGACCGGCGACCCCAATGGCGATGGCTATCTCGTCTTCGCCGCCCAGGCCGCGACGCCGCG
GCTGGTTGCCTTTGCGGTCCGGCACACCTCGGGTTATTTGCGCGTCGCGCTGCCGGGCGCCGAATGCGAGCGACTGCACC
TGCCGCCCATGTGTGACCGAGACACCACGCATTGCGTGTCGGTCGACGTTCGCGGCACCGGCACCGGAATCTCGGCGAGC
GATCGCGCCTGGACCATCGCGGCACTGGCTTCGGCCACCTCCGTCGCCGCCGATTTCCAACGTCCGGGCCATGTGGTGCC
CGTGCAGGCGCAAGCCGACGGTGTGCTGGGTCGGCGGGGACCCGCCGAGGCGGCCGTCGACCTGGCCGCCTGGCGGAAC
GGCGGCCGGCCGCCGCGCTCTGCGAGATCGTCTCGCCCGATAATCCCGTCCAGATGGCGCACCACGCCGAGTCGGTCGAA
TTCGCCGTCGAACACGGACTGGCCATGGTCTCGATCGGGGAGCTGGTGGCGTATCGCCGGCGGATCGAGCCCCAGGTGGT
CCGGTTTACGGCAGCGACGCTGCCCACCTGGGCCGGCGCCTCGCGTGTCATCGGCTTTCGTGACGTTTACGACCTCGGCG
AGCATTTGGCGGTCATCGTGGGTGCGGTCGGTGCCGGGGTGCCCGTGCCGCTGCACGTCCACATCGAGTGCCTGACGGGC
GACGTGTTCGGCTCGACGGCGTGCCGCTGCGGCGAGGAACTCAACGGCGCGCTGGCGAGGATGTCGGCTCAGGGCAGCGG
CGTGGTCTTGTATCTGCGTCCGCCCGGACCCGCGCAAGCGTGCGGCTTGTTCGCCCGGGGCGATGCGGCGACCGATGTCA
TGCCGGAGACCGTGACATGGATCCTGCGCGATCTTGGGGTGTATGCGATCCGACTTTCCGATGATGTGCCAGGATTTGGG
CTTGTCATGTTCGGGGCGATCCGAGAAGCCAGCACGTTGGCGGCCGCAGGTTGAACCATCCAGACCTGGCCGGCAAGGTC
GCGATCGTTACTGGGGCGGGCGCCGGAATCGGTCTGGCGGTTGCCCGGCGACTCGCCGACGAGGGCTGCCATGTGCTGTG
CGCGGACATCGATGGTGATGCCGCGGATGCCGCGGCCACCAAAATCGGTTGTGGCGCAGCGGCCTGCCGGGTTGACGTCA
GCGACGAACAACAGATCATCGCCATGGTCGACGCCTGTGTTGCCGCGTTCGGCGGGGTGGACAAGTTGGTCGCCAACGCC
GGTGTCGTTCATCTGGCTTCGCTCATCGACACCACCGTCGAGGACTTCGATCGGGTCATCGCGATCAATCTCCGCGGCGC
CTGGCTGTGCACCAAGCATGCGGCACCGCGGATGATCGAGCGCGGCGGGGGAGCCATTGTCAACCTGTCGTCGTTAGCGG
GCCAGGTAGCGGTGGGCGGCACCGGCGCATACGGCATGTCGAAGGCCGGCATCATCCAGCTCAGCCGCCATCACCGCCGCC
GAACTGCGCTCGTCGGGCATCCGCTCCAACACGCTGCTGCCCGCATTCGTCGACACCCCGATGCAGCAGACCGCCATGGC
AATGTTCGACGGGGCCCTGGGCGCGGGGGGTGCGCGCTCGATGATTGCCCGGCTGCAGGGCCGCATGGCCGCACCGGAGG
AGATGGCCGGCATCGTGGTGTTCCTGCTGTCCGACGATGCGTCGATGATCACCGGCACCACCCAGATCGCCGACGGCGGG
ACGATTGCCGCGCTGTGGTGATCCCCTCGGGTCAGGCGGTTTCGAAAGATCACGCGAGACATTGCCTGCGACGGCATGCT
ACATATGTGATTCCGGTGTATTCGGGCCTCTGCGCATTGCTTTCGATCACAATGAGCTTGGCCGCGAGCCGTCTTGTTCG
TTGAGCCACGGGGCCGTTCGAATGCGTTCGTCAGAACTCCGGCTTGGCGGATTCTCGCTAGTTTGCTGACGTGTCATCGAGAG
CAATCGACGGCGACCTCGAGGGCCGTGCAGATGGCGCGCATCCGGATGTCGGCGAGGCGGCCAAGCCGATTCACCAATAC
CGCGACCGAGACACTTTCGACTGAGTCCAAATTCACCGCGGAACGGCGCGGGATCGGGTCGGAACCGGGTTCAAGAACAA
CCTCACTGGCTAGCCCTCGGATGGTCGTGGTGCAGGGCGCGACAAGTGCGCGTCGCAGCCGAGGGATCGCGGCATCGCGC
GACAGCACGACGACTGGTCGCCGACCGATCTCAGCCATCTCACACCACCACACCTCTCCGCGCGCCGGAAGTGCGGTCAC
GAGTCTCCAGCCGCCGCCGCCACGACGCTAGATCGCCCCACTCGTCGGGCTCATCGACCGGTGCTTGTCGTAGGCCGC
ATAGCTGGCATCCACCTCGGCCGATCGATGACGAGCCAGTAATGCCGCAAGGGCCTCATCGATGAGGGCTGCGTCAGTGA
TTCCTGCCCGCATGTCGCGCGCACTTGTCAAGAGTGCGGCGTCGACAGTAGTGCTCAGCCGTATGCGATTCATGCCACTA
CTATGCCACACTCCGGGGCGTGGATCCGCCTGATCGGACGCAACGTGCTCGATACGGGCGAAACATTGGTCGCTGGACGA
ATTGATGAGGTCTACCGCGCAGCGCAACGTCACCTGCAACCGGGCCGTCTTCACGGTGCGGGTTCCGTGTCGATGAACGA
CGCTGCGGCACAACACTTTTTGTACTTGTGCCCCGACCGCACCAGCACTGTTGGTTGCGGCCCGGTGGCCAGGCCATCA
CATCGTGGTCACCGTGTGCTGTCAGGTACGCGGCATACTCGGCGCGGGCCTCCGGCGAGTCCGGCTCCTGACCCTGTTCG
GCGCACCAGGCAGCGAAGGGTGCCACGCGGATCGCGGCGACCGCCAGTCCTGGGAAACCAGCCTCGGCGAATTCGACCAG
CTTTTGCTGCATCCTCCGGCAGTACAGCGGGTGCGCCACCGGCCCGTCCGGACCGGTCACCAGGTCGCTGCCGGCGAAGT
CTGGCCACAGGTCGAGCGCCCGCTCGTAGTCACCGGCAGGCAGCCACGCCAATGACACCGCGGTGATCGGTTCGGCGGAT
TCCGCCGCGGGTGTCTCATCGACGGGAGGCACCCGGCTGGCTCCGTTGTCACTCATGGTCCAACATCCTGCCGCATCACC
ACCGCACGCGGCATATGATGCTCGCAGTCGCGGTGCGCCCTTATCGCCATGAGCGAAATCTTCTGTATCACTGATCA
TTCCGAGCCTATGACGGCCCGGTTCTTGTCAGTGGTGCTTCGTAGAATCGAGGCATGAGGTCGGACACGCGCGAGGAGA
TCTCCGCGGCGTTGGATGCCTACCACGCCTCGTTGTCGCGGGTGCTCGATCTCAAGTGCGATGCGTTGACCACCCCGGAA
TTGCTGGCCTGTTTGCAGCGACTCGAGGTCGAACGGCGCCGCCAGGGCGCCGCCGAGCACGCCTTGATCAACCAACTCGC
TGGGCAAGCCTGCGAGGAAGAGCTCGGCGGGACGCTGCGCACGGCGTTGGCCAACCGGCTACACATCACTCCCGGTGAGG
```

FIGURE 4(continued)

```
CCAGCCGCCGCATCGCCGAAGCCGAAGACCTCGGTGAGCGCCGCGCCCTGACCGGTGAACCGCTGCCAGCGCAGTTGACC
GCGACCGCGGCCGCTCAACGTGAGGGCAAGATCGGCCGAGAACACATTAAGGAGATCCAGGCCTTCTTCAAGGAGTTGTC
CGCCGCGGTGGATCTGGGTATCCGCGAGGCCGCCGAGGCCCAGCTGGCCGAACTGGCCACCAGTCGGCGTCCCGATCACC
TGCATGGCCTGGCCACGCAGCTGATGGACTGGCTGCACCCCGACGGCAACTTTTCCGACCAGGAGCGTGCCCGCAAGCGC
GGCATCACGATGGGTAAGCAGGAATTTGACGGGATGTCACGTATCAGCGGTCTGCTGACCCCGGAGTTGCGGGCCACCAT
CGAGGCGGTGTTGGCCAAACTGGCCGCACCGGGGGCGTGCAACCCCGATGACCAGACCCGGTCGTGGATGACACACCGG
ATGCGGACGCGGTGCGCCGCGACACCCGCAGCCAAGCCCAACGACACCATGACGGTTTACTGGCCGGGCTGCGCGGGTTG
TTGGCCTCCGGTGAGCTAGGGCAGCATCGGGGGTTGCCGGTGACCGTCGTGGTGAGCACCACGCTTAAAGAGCTGGAAGC
CGCCACCGGCAAGGGGGTAACCGGTGGTGGTTCGCGGGTGCCGATGTCGGACGTTATCCGGATGGCGAGCAACGCGCACC
ACTATCTGGCATTGTTTGACGGCGCTAAGCCGTTGGCGTTGTATCACACCAAGCGGTTAGCTTCCCCGGCGCAGCGAATC
ATGTTGTACGCCAAGGATCGTGGCTGCTCCAGGCCGGGTTGCGACGCCCCGGCCTACCACAGTGAGGTCCACCACGTAAC
GCCGTGGACAACCACCCACCGTACCGACATCAACGACCTCACGCTGGCCTGCGGCCCCGACAATCGCCTTGTCGAAAAAG
GCTGAAAAACCCGCAAGAACGCCAAAGGCGACACTGAATGGCTACCGCCGGCCCACTTGGACCATGGCCAACCACGCATC
AATCGATACCACCACCCCGAGAAAATCCTGTGCGAACCCGACGACGACGAACCACATTGACACCCAATGACCGTGGCATT
GCCGGTCACGTCGCAACCAAGTACTGCGACCGTAGCCGCGCTCAAGGCTCGGGGTAGACGAGCGCGGAGAGAGGCACGTT
GCCGAGCTGCCTGCCGACGACGAGTATCCCAATATCGTGCTCACCCATAGCGTTTCAGCGGGCAACCAACGATTGCCGGC
CAGCGAATCTCGGTGGCGGTAGCCAGCATGAAGGACGCAGATGACCTCGCCGACTACGGGCTGAGCATAGAGCAGGTGCG
TGCAGCCGTCGACTCGCATGTGGACGTGGACCATTCTGTCTCAGCGCTGTGACCGCACGGTAGAGTTCGCCATCGTGGCT
GACGATGACGTCACCGGTCAGGATGGCTCCGGCGACGGCACCGATCCGCGCACCATGCTGGGCCGGTTTGCCAACCAGCA
CAACGAATGGGTGCGCCTGAGCGTGCGCCACGTGCTCGATGCGGGCGAAGCATTGGATGCCGGACAGATTGATTAGGTCT
ACCGCCACTTTCGGCAGGAAAAGGCACTGGACACACGCCACCGAGCCGGCCGTACCACCGTTGACACTCGGCATCAGCAA
CCCCGGAAACAGCCGAACCCCTGATCATCTGGCCGACCTCGCCCCTGGCCGCACCGCGACCATCGGGCGTGCGGGATTCCAG
CTGCCTGCGCGTGGACCGCTACAACGACCAGGCGTCCGGGCGAGCGCTCATCGAGATCCGGTTGTGCAACGAACGTGCCA
CGCCGATGCCAATCCCGATCGGGCTGTGGATGTTTCAGACCAAGCTCCACGTCAACGCCGGCGGCGCTGACGTGTTCCTG
CCGGTCTGCGACGTGCTGGAGCAAGACCTCGCCGAGCGCGACGAGGAGGTACGCCAGCTGAACCTGCAGTACCGCAACCG
GTTGGAGTATGCGATCGGGCGGACTTGCTCGGCGGCCTGGTCGGTGAACGGCTCGCGGCGCCCGTCGGCAGTGTGGACCA
CCTGGCTGCCGGTCGCCGAAACACCCCACACCCGGGCCCGGTCGGTGGAGAACGCGCTGTTGTCCATGGACAGTCGCGGA
GGGGTTACGTAGCGGACTGGCGTCGTTCGTCGCGGATATGGAAGCTGGTTTCAGGGTCAGGCGGCTGTCGCGGCCGAGC
TGCCCGAGCACCTGCACCCGACCGCCGACGAGAGGCTGGCTCATGTTGCGGCCGAAAAGGAAGCGCTGCGCTGCTTCCAG
TTCATGAACCAGGTGATGCGCGATCACCGTAAA
```

FIGURE 4(continued)

```
AAGCTTCAGGTTCGCGGTCCGACCCTGTTCGACGGCTACCTGAATCAACCCGATGCCACCGCCGCGGCGTTCGACGCCGA
CAGCTGGTACCGCACCGGCGACGTCGCGGTGGTCGACGGCAGTGGGATGCACCGCATCGTGGGACGCGAGTCGGTCGACT
TGATCAAGTCGGGTGGATACCGGGTCGGCGCCGGTGAAATTGAAACGGTGCTGCTCGGGCATCCGGACGTGGCGGAGGCG
GCAGTCGTCGGGGTGCCCGACGATGATCTAGGCCAGCGGATCGTTGCCTACGTAGTCGGCTCAGCGAATGTCGATGCGGA
CGGGCTTATCAACTTTGTTGCCCAACAACTTTCGGTGCACAAGCGCCCGCGCGAGGTGCGTATCGTAGATGCGCTGCCGC
GCAACGCGTTGGGGAAAGTGCTCAAGAAGCAGTTGCTGTCAGAAGGCTGAGCTACGGCGAATTATCGTGTACCGCTGGAC
AGTTACGCTGGCACACTGTTACTCCGACGGCCCGGTGAGCTTAGCGCATGGGCCTTGTTGCCGCGCCACTGTAGGGCTTC
CAGGGCGACGGCCACATGGACGGAGGTGTGGTCGAGCGGTCGCGGTAGCAGCCGCTGAGCGGACTCGAGTCTGCGCAGAA
ATGTATTGCGGTGAGTGTGGAGACGTTTTGCGGCCCGGGAGGCGTTGCACTGCTCGTTGATGAAGGTCAGCAGGGCCGTT
TGTAGATCTGGGCTGGCAGACTCGAGGTCTCCAAGCGTACTCGTGATGAATTCGCTTGCAGCATCTGGATTTTGGCTGAT
CAATGCCACCATCTTAACGTCGGCAAAGAAGGCGACCCGCTGGGTCGACCGTAGCCGTGACAAGGTGCGCTGGGTGATGA
GCGCTTCGAGGTGGCTGCGCCGGAACCCCTCCACCCCGTTGGCGGTGGTCCCGATGGCGATGCGCGCCCCGGGTGCGTTG
TCCACCGCCGCCTGCACTGTGTCGATGTCGAGTCCGTCGGCGTCGGTCACCCACGCCCAGCGGCTCGCCGCCCCGGCGAC
CACCGTCAGCGGTCGTGTCGATCCCACGGCGTGGCAGAACAGATCAGCCGCCCGGTCGAGGTAGCTGTGGTCACCGTCGA
GCTCGTCGCTCCAGATGATGGCAGCGGTATGGGCACGACTCAGCGGGTAGCCCAATTTCGCTTCGGCCCGTTCGGGGCTG
ATAGGGGCGCCATCGAGAATCAGCCCGACGACCTCGAGGCGTTCGGCATGGGTGCTGCGGGTCAGTTCGTCGTGTTCCGA
CTGCACTTGCGCGGCGATACCGGTCAGCGTGGCCTCGATGAAGTCGTTGACGGAGCGGGCCGACACGTCTAGCAGCTCGC
GCAGCTCTTGGGGGTCGGAAGTGAGTTCGAACGCAATCCCCATCCAGAACCGCCACCCGATGTGCTCACCGGTTCGATAG
ATGTTGAACGCTACTGTGTCCAGCCCCCGGCGCACCAGGTCTCGGGCCATCCGCAGTGGCTCGGTGCCGAGATTGGCGGG
CACCCGAGCACCAGGGTCACGCAGGTTGGCCGCAGCCCAGTACACCAGGTTGGCGCGATTGGCCGTCTGGACAACCTTCG
CAAGCACCGGATCGTTGGCGATCGCCGGATTGGCCGCAATCGTGGCACGGTCCAGTTCCTCGATCCACTCCGGGCTGGGA
TTGAGGGCGATGCGTGCTCCCTCGCGGATCAGCTCACGAATTCGCGGCGAAGGTTGTTGCCATGCCACGCGCCGATCTTA
GGGCCAGCGGGTGCAATTTGCACACTATGTTGGCACTATTGTGCCGGATTCACACTGCACGGCCGGTGTGTGCGCGAAAT
CACGGTGTGGGTCTGCTGGATGAGTCGACCGTGTTGAACAACTTGCGACACACCGCAATTTGCGAAATCCGCCACCGACC
GGGCATAGTAACCCAGCTAGTCGTCGTTGTCGCGTCGAACCACATGGTGAACTGTGCGGCGGGTGCATTTGCACATCAA
GTGGGCGCTGATTGGGAAGATTTACCCTTCGGCGGCGGCGGTAGGTGCAGATTGCACTTTGGCTCATGCTGATTGAAATT
TTTTGACCTGTTGCGGTCCTTGCGGGCTCGCCATCATTGGCGGCAGTTCGTCACCGACGAATCGGGGCCAAGGACGTAGG
CGACCAGTTCGCTTGACTGCTAACCGCTCCTGATCGTACCCGTGCGAGTGCTCGGGCCGTTTGAGGATGGAGTGCACGTG
TCTTTCGTGATGGCATACCCAGAGATGTTGGCGGCGGCGGCTGACACCCTGCAGAGCATCGGTGCTACCACTGTGGCTAG
CAATGCCGCTGCGGCGGCCCCGACGACTGGGGTGGTGCCCCCCGCTGCCGATGAGGTGTCGGCGCTGACTGCGGCGCACT
TCGCCGCACATGCGGCGATGTATCAGTCCGTGAGCGCTCGGGCTGCTGCGATTCATGACCAGTTCGTGGCCACCCTTGCC
AGCAGCGCCAGCTCGTATGCGGCCACTGAAGTCGCCAATGCGGCGGCGGCCAGCTAAGCCAGGAACAGTCGGCACGAGAA
ACCACGAGAAATAGGGACACGTAATGGTGGATTTCGGGGCGTTACCACCGGAGATCAACTCCGCGAGGATGTACGCCGGC
CCGGGTTCGGCCTCGCTGGTGGCCGCGGCTCAGATGTGGGACAGCGTGGCGAGTGACCTGTTTTCGGCCGCGTCGGCGTT
TCAGTCGGTGGTCTGGGGTCTGACGGTGGGGTCGTGGATAGGTTCGTCGGCGGGTCTGATGGTGGCGGCGCTCGCCGT
ATGTGGCGTGGATGAGCGTCACCGCGGGGCAGGCCGAGCTGACCGCCGCCCAGGTCCGGGTTGCTGCGGCGGCCTACGAG
ACGGCGTATGGGCTGACGGTGCCCCCGCCGGTGATCGCCGAGAACCGTGCTGAACTGATGATTCTGATAGCGACCAACCT
CTTGGGGCAAAACACCCCGGCGATCGCGGTCAACGAGGCCGAATACGGCGAGATGTGGGCCCAAGACGCCGCCGCGATGT
TTGGCTACGCCGCGGCGACGGCGACGGCGACGGCGACGTTGCTGCCGTTCGAGGAGGCGCCGGAGATGACCAGCGCGGGT
GGGCTCCTCGAGCAGGCCGCCGCGGTCGAGGAGGCCTCCGACACCGCCGCGGCGAACCAGTTGATGAACAATGTGCCCCA
GGCGCTGCAACAGCTGGCCCAGCCCACGCAGGGCACCACGCCTTCTTCCAAGCTGGGCTGGCCTGTGGAAGACGGTCTCGC
CGCATCGGTCGCCGATCAGCAACATGGTGTCGATGGCCAACAACCACATGTCGATGACCAACTCGGGTGTGTCGATGACC
AACACCTTGAGCTCGATGTTGAAGGGCTTTGCTCCGGCGGCGGCCGCCCAGGCCGTGCAAACCGCGGCGCAAAACGGGGT
CCGGGCGATGAGCTCGCTGGGCAGCTCGCTGGGTTCTTCGGGTCTGGGCGGTGGGGTGGCCGCCAACTTGGGTCGGGCGG
CCTCGGTCGGTTCGTTGTCGGTGCCGCAGGCCTGGGCCGCGGCCAACCAGGCAGTCACCCCGGCGGCGCGGGCGCTGCCG
CTGACCAGCCTGACCAGCGCCGCGGAAAGAGGGCCCGGGCAGATGCTGGGCGGGCTGCCGGTGGGGCAGATGGGCGCCAG
GGCCGGTGGTGGGCTCAGTGGTGCTGCGTGTTCCGCCGCGACCCTATGTGATGCGCGCCATTCTCCGGCGGCCGGCTAGG
AGAGGGGGCGCAGACTGTCGTTATTTGACCAGTGATCGGCGGTCTCGGTGTTTCCGCGGCCGGCTATGACAACAGTCAAT
GTGCATGACAAGTTACAGGTATTAGGTCCAGGTTCAACAAGGAGACAGGCAACATGGCCTCACGTTTTATGACGGATCCG
CACGCGATGCGGGACATGGCGGGCCGTTTTGAGGTGCACGCCCAGACGGTGGAGGACGAGGCTCGCCGGATGTGGGCGTC
CGCGCAAAACATTTCCGGTGCGGGCTGGAGTGGCATGGCCGAGGCGACCTCGCTAGACACCATGGCCCAGATGAATCAGG
CGTTTCGCAACATCGTGAACATGCTGCACGGGGTGCGTGACGGGCTGGTTCGCGACGCCAACAACTACGAGCAGCAAGAG
CAGGCCTCCCAGCAGATCCTCAGCAGCTAACGTCAGCCGCTGCAGCACAATACTTTTACAAGCGAAGGAGAACAGGTTCG
ATGACCATCAACTATCAATTCGGGGATGTCGACGCTCACGGCGCCATGATCTCGCGCTCAGGCCGGGTTGCTGGAGGCCGA
GCATCAGGCCATCATTCGTGATGTGTTGACCGCGAGTGACTTTTGGGGCGGCGCCGGTTCGGCGGCCTGCCAGGGGTTCA
TTACCCAGTTGGGCCGTAACTTCCAGGTGATCTACGAGCAGGCCAACGCCCACGGGCAGAAGGTGCAGGCTGCCGGCAAC
```

FIGURE 5

```
AACATGGCGCAAACCGACAGCGCCGTCGGCTCCAGCTGGGCCTGACACCAGGCCAAGGCCAGGGACGTGGTGTACGAGTG
AAGGTTCCTCGCGTGATCCTTCGGGTGGCAGTCTAGGTGGTCAGTGCTGGGGTGTTGGTGGTTTGCTGCTTGGCGGGTTC
TTCGGTGCTGGTCAGTGCTGCTCGGGCTCGGGTGAGGACCTCGAGGCCCAGGTAGCGCCGTCCTTCGATCCATTCGTCGT
GTTGTTCGGCGAGGACGGCTCCGACGAGGCGGATGATCGAGGCGCGGTCGGGGAAGATGCCCACGACGTCGGTTCGGCGT
CGTACCTCTCGGTTGAGGCGTTCCTGGGGGTTGTTGGACCAGATTTGGCGCCAGATCTGCTTGGGGAAGGCGGTGAACGC
CAGCAGGTCGGTGCGGGCGGTGTCGAGGTGCTCGGCCACCGCGGGGAGTTTGTCGGTCAGAGCGTCGAGTACCCGATCAT
ATTGGGCAACAACTGATTCGGCGTCGGGCTGGTCGTAGATGGAGTGCAGCAGGGTGCGCACCCACGGCCAGGAGGGCTTC
GGGGTGGCTGCCATCAGATTGGCTGCGTAGTGGGTTCTGCAGCGCTGCCAGGCCGCTGCGGGCAGGGTGGCGCCGATCGC
GGCCACCAGGCCGGCGTGGGCGTCGCTGGTGACCAGCGCGACCCCGGACAGGCCGCGGGCGACCAGGTCGCGGAAGAACG
CCAGCCAGCCGGCCCCGTCCTCGGCGGAGGTGACCTGGATGCCCAGGATCTCTCGGTAGCCCTCGGCGTTGACGCCGGTG
GCGATCAAGGTGTGCACTCCGACGACGCGGCCTGCCTCGCGCACCTTGAGCACCAGGGCGTCGGCGGCGAGGAAGGTATA
CGGGCCGGCATCGAGCGGGCGGGTCCGAAACGCCTCTACGGCTTCGTCGAGCTCTTTGGCCATGATCGACACTTGCGACT
TGGAAAGCTTTGTCACACCAAGTGTTTCGACCAGGCGCTCCATCCGGCGAGTGGATACTCCCAGCAGGTAGCAGGTCGCC
ACCACGCTGGTCAGTGCGCGTTCAGCTCGCTTGCGGCGCTGCAGCCAGTCCGGGAAATAGCTGCCCTGGCGCAGCTT
GGGGATCGCGACGTCGATGGTTGCGGCACGGGTGTCGAAATCACGGTGGCGGTAGCCGTTGCGCTGATTGGACCGCTCAT
CGCTGCGTTCGCGGTAGCCCGCCCCGCACAGGGCGTCGGCTTCAGCCCCCATCAAGGCGGCGATGAACGTCGAGAGCAGC
CCGCGCAGCAGATCCGGGCTCGCCTGTGCGAGTTGGTCAGCCAGAAGCTGCTCGGTGTCGATAAGATGAGAAGAGGTCAT
TGCGTCATTTCCTTCGATTGACTTTTGCTGGTCGTTTCGAAGGATCACGCGATGACCGCCCACTACTGGGCTACGACACG
CCCACCGGCCTTACCTGCCCGTACACCACACCCCTGGACGTAACTTGACACCAATCCACAGCACCGAGCAGTGACAGAAG
GTGCCCCAAGGTGTGGTGAAACTCGCTGGACGGTCCCCAGGATGTTGGCAGCACATTCACCGGACATGACCGGAGCAAGA
CCGGACATCCTCCCATACCGTCGTCGCCGTGTACATCCGTACATCCGTCCTGGCAGGTGCTGGGTTGACCAAAATCAGCCC
AACACCTGCCACGACGATGAAGCGGGTTGCGCTGGCATGTCTTGTCGGCTCGGCGATCGAATTCTACGACTTCCTTATCT
ACGGCACCGCTGCGGCGCTGGTGTTTCCCACCGTGTTCTTCCCACACCTGGATCCCACGGTGGCCGCCGTGGCCTCGATG
GGGACATTTGCTGTGGCGTTCCTATCCCGGCCGTTCGGCGCGGCCGTCTTTGGATACTTTGGAGACCGCCTCGGCCGCAA
GAAGACCCTGGTCGCCACACTGTTGATCATGGGCCTGGCAACCGTGACTGTCGGGCTGGTTCCAACGACAGTGGCCATCG
GCGCCGCGGCCCCACTGATCCTGACGACCATGCGGCTGCTGCAAGGGTTCGCGGTCGGCGGCGAGTGGGCCGGTTCGGCG
CTGCTGAGCGCCGAGTACGCCGCCCGCCAGCAAACGTGGCTGGTACGGATGTTCACCGTTGTGGGTGGCGGCATCGCGCT
GGTACTGACCAGCCTGACCTTTCTGGGCGTGAACTACACCATTGGCGAAAGCAGCCCCACATTCAGTCAGTGGGGGTGGC
GCATACCGTTTCTGGTCAGTGCGGCGCTGATCGCCGTCGCCCTATACGTGCGGTTCAACATCGACGAGACCCCGGTGTTC
GCCCGGGAAAGGGCAGACGAAAAAACCCGTTTGGGCCCAGCCGAAACGCCGATTGCCCAAGTACTGCGGCGGCAGCGGCG
AGAGATAGTCTTTGGCCGCCGGCAGCGCCGTTTGCTGCTTCGGCTTCGTCTACCTGGCCAGCACTTACTTGGCCAGCTACG
CTCAAACCCGACTGGGGTATTCGCGCGGCAGCATCCTGTTCGACAGTGTGCTGGGTGGACTGCTGTGCATCGTGTTCACC
GCGCTTTCTTCCGCTGCGACCAACTCGGGCGCCGCCGCGTCCTATTGGCCGGGTGGGCGGTGGCTCTACCCTGGTC
GCTGTTGGTCATGCCGCTGATCGACTCCGGCAGCCCCAGTTTGTTCGCGGTGGCTGTCGTCGGCATGTATGCCATCGGCG
GATTCGGTTTCGGACCCACGGCATCGTTCATCCCAGAACTGTTTGCTACTAGCTACCGATACACGGGCAGCGCGCTCGCG
GCGAATCTCGCTGGGGTTGCCGGCGGCGCGCTACCGCCGGTGATTGCCGGCGCGCTGGTGGCAACCTATGGCAGCTGGGC
GATCGGTGTCATGCTGGCCATCCTCGCGTTGATCAGCCTGGTATGCACCTATCGGTTGCCCGAAACCGCCGGATCGGCCC
TCGTCAGCCGCTAGTTGGCGTGCAGGTCCTCGTTGAGGGCAATGCCCTGACCGTCGCGGGCCAGCACTTCGACCGCCCG
CTGACGGAATTGCGGCGAAACAGCAGGTTGCTGCTCCCGGAGAGCTCACGCGCCTTGACCGAATTGCTGTCGGGCATGGT
GACCCTCGTGCCGGCGGTCACGTACAGCCCGGCCTTCCACCACGCAGTCGTCGCCCAGTGAGATGCCCAGACCGGAGTTGG
CGCCGAGCAGACAACGCTTGCCGATCGAAATGACGTGTGTTCCACCGCCAGACAGCGTGCCCATGATCGACGCTCCGCCG
CCGACATCGGAGCCGTCGCCCACCACCACACCCGCCGAGATGCGGCCTTCCACCATCGAGGCGCCCAGGGTGCCGGCGTT
GTAGTTGACGAAGCCCTCATGCATCACGGTGGTGCCCGGCGCCAGGTGAGCGCCCAACCGCACGCGGTCGGCATCGGCGA
TACGTACGCCGGTGGGCACGACGTAGTCGACCATCCGGGGAAACTTGTCGACGCCATACACAGTCACCGGTCCGCGGCGG
CGCAGCCGCGCCCGCACCGCCTCGAAACCGTCTATGGCGCAGGGTCCGTGATTGGTCCACACCACATTGGTCAGCACCCC
AAACAAGCCGCCGGCGTTCAACCCATGGGGCGCCACCAGGCGGTGCGACAAGAGGTGAAGCCGCAGGTAAGCATCGTATG
GGTCAGCGGCGACATCGTCGAGCGAGCCGATGACCGTACGGACCGCGATGGTCTCGGTGCGGCGGTCGTCATCGCGGCCG
ATCAGCGCGGCCAGCTCGACAGGAACGTCGGACACCGCCAGTCGTGACGTCGCGCTGGTGCCCGATTCGGTCAGTTCCGG
CGCGGGAAACCAGGTGTCGAGGACCGATCCGTCAGCGGCGAGGGTAGCCAGGCCGATGCCTGCTGCTCCAGTCACGGTCG
ACACGCTACTTGTGCCGCCGAACAGACACAAAACCACCCTATTTCGACCAGAATCGGGTGCTTTTGCGTCTGCTCGGCCA
ACTAAGCTAGCGCCGTGCTGGATTTGCGCGGGGACCCGATCGAATTGACCGCGGCGCTGATTGACATCCCCAGCGAGTCG
AGGAAGGAGGCACGCATCGCCGACGAGGTGGAAGCGGCGTTGCGCGCTCAGGCATCGGGGTTCGAGATCATCCGCAACGG
CAACGCGGTGCTGGCGCGTACAAAGCTGAACCGGTCCTCGCGGGTGCTGTTGGCCGGACACCTGGACACCGTGCCAGTGG
CCGGCAACCTGCCTAGCCGCCGCGAGAACGACCAGCTGCACGGCTGCGGCGCAGCCGACATGAAATCCGGCGACGCGGTC
TTCCTTCATCTGGCCGCTACACTGGCCGAACCGACGCACGATCTAACACTGGTGTTCTACGACTGCGAGGAAATCGATTC
GGCGGCAAACGGTTTAGGCCGCATCCAGCGCGAGCTGCCGGACTGGCTATCCGCGGATGTAGCCATCTTGGGTGAGCCCA
```

FIGURE 5(continued)

```
CCGCCGGCTGCATCGAGGCTGGTTGCCAGGGCACGTTGCGTGTCGTCCTCAGCGTGACCGGAACTCGCGCGCATTCAGCG
CGTTCGTGGTTGGGTGACAACGCAATCCACAAGTTGGGTGCTGTGCTGGACCGGTTGGCCGTCTACCGGGCACGCAGCGT
CGACATCGACGGTTGCACCTATCGGGAGGGCCTCTCGGCGGTGCGCGTAGCAGGCGGCGTCGCCGGCAACGTGATCCCTG
ACGCGGCCTCGGTCACGATCAACTACCGCTTTGCCCCCGACCGGTCGGTGGCCGCGGCATTGCAACATGTCCATGACGTG
TTCGACGGGCTCGACGTGCAGATCGAGCAGACGGACGCCGCGGCCGGTGCGCTGCCTGGCCTGTCCGAGCCCGCGGCCAA
GGCGCTGGTCGAGGCCGCCGGCGGGCAGGTCCGGGCCAAGTATGGCTGGACTGATGTGTCGCGCTTTGCCGCTTTGGGCA
TACCGGCGGTCAATTACGGCCCGGGTGATCCCAACCTGGCGCACTGCCGCGACGAACGGGTGCCCGTCGGCAACATCACC
GCGGCCGTGGACTTGCTGCGCCGATACCTGGGTGGCTAGCGCTGCTGTGGCCCCAAGCGTGCTGCCGCCTTGGTCGCGTC
GGCTGCCGCGGCTGCCATCCCGATCCCGGCCAGCTCCTCAGCCACCGCGGTCAGCTCGGCAGCATCTCCGTCGGCCAGGC
CACGGGCGTGCTTGACGAGGATATTTCCTACGGTGCAGTCGATTTCGGCGGCGAGGCGAGTCACCGGGTCCACCGCACGG
ATGTCGCCCAACCGAACCGCGTTATGCCAGGCGCATAGGGCCACCGCCGCCTGCCCGGCCCGCTCAGCCGTCCGGGCGGC
CTCCCGGGCCGCCGCGATGGCCCCTGTCATGTCCTGGGCCGCCGCCCTGGTCCAGGCCCTGGCCAGCCCGAGCTCGGGTG
CGAACAACGCGGACTTCGTTCCGTGCCGAGCTTCAGCGCGCTGCAGTGTTTTTGCAGACTCGGCGATATGGCCTTGCTGC
GCGATGGCCGTTGCCAACAACATCAGCGACAGCGGACCCCACGAGTAGCCGGTTCGTTCCAGTGTGGCGGCGGCCGGCTC
CAGCATCGATGCCGCGGCGCCGAATTCGCCTTTGGTGATCAGTACGTACGCCAACAACACTTCACCGATGGACCGGCCAG
GTTGCTGCAGCTAGGCGAAGTCGGTGAACCGCTTGGCCAGCTCCTGAGCCGGCGCGACGTCGCCTGCCAGCAGCAGCGAC
GTGATCTGAGCCAGGCCCACGGTGAACCGCAGCAGCCCCGGATGTTCGGCGGCCGACGCCCGTTCGGCCAGCCGGTCAAC
GTCGCGAACCGGCCCATTCGTGCCGATGATAACGCGGCAGCGCTGGCGGCCCAGGCCACGGCCATGTCGTCGGCAGCCG
GTCCGGACAGCACCTCGGTGGCCAGCGTGATGGCCCGCGGCAAGTTTCCGGAGTTCATCGCAAACGTGGCCGCCAGCGCA
TCCAGGGTGCTGCGGGCCGTGGGCTCGGTCACTCGGCTGCGGGTCGTCTGCAGAAACGCCGTGGCGCGCTCGGGCTCGTT
GAGCATCCAGAACCGATTCGCCGCCCGGGGTATCGCCCAGGCCATCAGCTCGGTCTCGGTCAATTCGGCGGGATTCACCG
CCGCCAGCACCGCGTCAGCTTCGCGACCGCGACCCTGCCAACCGAGTGCGTAAGCCAAGGGCAGGCGTGCCGCCAGGGCG
TCCGACCTATCCAGCGCTGCCCGCGCCAACCGTTCGGCAAGCCGGACGTCGCCGAGCCGCAGGGCCTGCCCGGCTGCGGT
CGCCGCATCCGTGACCGCGCGCCGGGGTAGCACTGGCGGGACGTCGATGGCCAGTGAGGACAGCCGTAACTGATCGCTGA
CATGGTCGGATGGGTGCTTGGCCAGCTGCGCGACCAGCGACACGCGCAATGCATGCGCGTGCTCGGCCGTCAATACGGCG
CGTGCGCGGTCGGCGTACAGCGGATGGCCGACAAAAATCTCGCTGGTATCGCTGTCGGGACCCACCCGCACCGCGCCGGC
GGCTTCGGCTTGGCCGAGCGTGTCCAACTGCTCGCCACCGACCAGGGCCACCAGGTCGGTGCGCGCCAACGGTTCGGCGA
TGGCGAGGTAGTCGACAACGGCGCGGGCCGGTTCCGGCAGGGCGCACAGGTACTCGTCGATCACGCCGGACAGCGGCCGA
CGATCCTCGTCTCGACAGCGCCACCGGCCGTCCACGTGTTCGAGACCACCGCCGTCGATGAGGTGGCGCAGATACAACGG
GTTGCCAAGGCTGCCGCCGAAAGAGCTCGTCGGCGTCGGCGACGTCCAGTGTCGCGTCCAGCGCCGACTCCACGAACGCCG
CGGTTTGGGCCCTGTCGAGCGGCTCGATGGCGACCCGGGTGAGCAGGTCATCGGACCAGAGCGCAGCTATAGCGTCCGGT
GGCTCGGCCTCCGAGGCGACGGTGACCACCAGCCGCGCCGCCCCGGCCCGCGCCAGCTGGTACACCAAGGTGGCCGACAG
CGGATCCAGGTTGTGCGCGTCGTCGACCACCAGCAGCAGATCGCCAGCATCACCGGTCAGGGAACTACGCGCCGCCCGCA
GCAGCGCCGCGGGCCGCCCAATGTCGGCTCCGGAGGCGGGCAGGCTGATCAAATGGCGGAAAGCGCCGAACGGGATGGCC
CGCCCTGGAGCGGTTCCCACCACCCAGCGAGCCCGGCCGCTCCTGCCGTCCTCGGACATGACCTGCTCGGCAGCCAGTTG
CGCCAGCAGCGTCTTGCCGACGCCGTGTGGCCCGACCAGCACCACCCCGCACCGATCCGGACTGTCGACGGCCGCCTCCA
CGTGTTTCCAGACGCGCATCGCCGGATTTTATGGCGGTTGCGCCCAACGACATTCGAGCGGGGCGATAGCCAAAAATGTA
CGCGGTTCACATCGGTGGTCTACGTTCTGGTGTATGTCGGCGAAAATCGACATTACCGGTGATTGGACTGTGGCCGTGTA
TTGCGCGGCCTCGCCAACGCACGCGGAGTTGCTAGAGCTGGCCGCCGAAGTCGGCGCGGCAATCGCCGGACGTGGCTGGA
CGCTGGTGTGGGGAGGTGGCCATGTTTCGGCGATGGGGGCTGTCGCCTCGGCGGCGCGAGCCTGCGGCGGCTGGACCGTC
GGCGTGATTCCCAAGATGCTGGTGTACCGCGAACTGGCTGATCACGACGCCGACGAGCTAATCGTCACCGACACCATGTG
GGAGCGCAAGCAGATTATGGAAGATCGCTCAGATGCGTTCATCGTGTTGCCGGGCGGTGTCGGCACCCTAGACGAGCTGT
TTGACGCATGGACCGACCGGGTATCTCGGTACCCATGACAAACCCATTGTGATGGTAGATCCCTGGGGGCATTTCGATGGA
CTGCGGGCATGGCTGAACGGATTGCTCGACACCGGTTACGTCTCACCCACGCGCGATGGAACGGCTGGTGGTAGTCGATAA
CGTCAAGGACGCTCTGCGGGCCTGCGCACCTTCCTGAGGTTGGTCGACAACCAATTCGACATTTCGCAAACGAATCGAGG
GCTTACGTGTCCGATTACTACGGCGGCGCACACACAACGGTCAGGCTGATCGACCTGGCAACTCGGATGCCGCGAGTGTT
GGCGGACACGCCGGTGATTGTGCGTGGGGCAATGACCGGGCTGCTGGCCCGGCCGAATTCCAAGGCGTCGATCGGCACGG
TGTTCCAGGACCGGGCCGCTCGCTACGGTGACCGAGTCTTCCTGAAATTCGGCGATCAGCAGCTGACCTACCGCGACGCT
AACGCCACCGCCAACCGGTACGCCGCGGTGTTGGCCGCCGCGGCGTCGGCCCCGGCGACGTCGTTGGCATCATGTTGCG
TAACTCACCCAGCACAGTCTTGGCGATCGTGGCCACGGTCAAGTCGGCGCTATCGCCGGCATGCTCAACTACCACCAGC
GCGGCGAGGTGTTGGCGCACAGCCTGGGTCTGCTGGACGCGAAGGTACTGATCGCAGAGTCCGACTTGGTCAGCGCCGTC
GCCGAATGCGGCGCCTCGCGCGGCCGGGTAGCGGGCGACGTGCTGACCGTCGAGGACGTGGAGCGATTCGCCACAACGGC
GCCCGCCACCAACCCGGCGTCGGCGTCGGCGGTGCAAGCCAAAGACACCGCGTTCTACATCTTCACCTCGGGCACCACCG
GATTTCCCAAGGCCAGTGTCATGACGCATCATCGGTGGCTGCGGGCGCTGGCCGTCTTCGGAGGGATGGGGCTGCGGCTG
AAGGGTTCCGACACGCTCTACAGCTGCCTGCCGCTGTACCACAACAACGCGTTAACGGTCGCGGTGTCGTCGGTGATCAA
TTCTGGGGCGACCCTGGCGCTGGGTAAGTCGTTTTCGGCGTCGCGGTTCTGGGATGAGGTGATTGCCAACCGGGCGACGG
```

FIGURE 5(continued)

```
CGTTCGTCTACATCGGCGAAATCTGCCGTTATCTGCTCAACCAGCCGGCCAAGCCGACCGACCGTGCCCACCAGGTGCGG
GTGATCTGCGGTAACGGGCTGCGGCCGGAGATCTGGGATGAGTTCACCACCCGCTTCGGGGTCGCGCGGGTGTGCGAGTT
CTACGCCGCCAGCGAAGGCAACTCGGCCTTTATCAACATCTTCAACGTGCCCAGGACCGCCGGGGTATCGCCGATGCCGC
TTGCCTTTGTGGAATACGACCTGGACACCGGCGATCCGCTGCGGGATGCGAGCGGGCGAGTGCGTCGGGTACCCGACGGT
GAACCCGGCCTGTTGCTTAGCCGGGTCAACCGGCTGCAGCCGTTCGACGGCTACACCGACCCGGTTGCCAGCGAAAAGAA
GTTGGTGCGCAACGCTTTTCGAGATGGCGACTGTTGGTTCAACACCGGTGACGTGATGAGCCCGCAGGGCATGGGCCATG
CCGCCTTCGTCGATCGGCTGGGCGACACCTTCCGCTGGAAGGGCGAGAATGTCGCCACCACTCAGGTCGAAGCGGCACTG
GCCTCCGACCAGACCGTCGAGGAGTGCACGGTCTACGGCGTCCAGATTCCGCGCACCGGCGGGCGCGCCGGAATGGCCGC
GATCACACTGCGCGCTGGCGCCGAATTCGACGGCCAGGCGCTGGCCCGAACGGTTTACGGTCACTTGCCCGGCTATGCAC
TTCCGCTCTTTGTTCGGGTAGTGGGGTCGCTGGCGCACACCACGACGTTCAAGAGTCGCAAGGTGGAGTTGCGCAACCAG
GCCTATGGCGCCGACATCGAGGATCCGCTGTACGTACTGGCCGGCCCGGACGAAGGATATGTGCCGTACTACGCCGAATA
CCCTGAGGAGGTTTCGCTCGGAAGGCGACCGCAGGGCTAGCGGATTCCGGGCGCAGTCTCGATACCCGCACTGGACGCTC
GACGGTAACCAGGCACTATGGATGCGTGCGTTCAACACCGCCGGCCTCAGCCGGTCGTTCAACACCGCCGGCGTTAGCCG
GCCATTCAACACCGCCGGCGTTAGCCGGCCATTCAACGCTGTGCGGCCGTCCAGTCGCAGGTGATCGTGCGCTGATCATG
GCGATCGTCAACCGCACCCCGGATTCGTTTTACGACAAGGGTGCGACTTTCAGCGACGCGGCTGCCAGAGACGCGGTCCA
CCGGGCCGTCGCCGACGGTGCCGACGTCATCGACGTCGGCGGTGTCAAAGCCGGCCCGGGTGAACGCGTCGACGTCGACA
CCGAGATCACGCGGCTGGTGCCGTTCATCGAATGGCTCCGCGGTGCTTACCCGGACCAGCTGATCAGTGTCGACACCTGG
CGCGCGCAGGTGGCGAAGGCGGCCTGCGCGGCGGGGCGGACCTGATCAACGACACCTGGGGTGGCGTCGACCCGGCCAT
GCCCGAGGTGGCCGCCGAGTTCGGCGCGGGCCTGGTGTGTGCGCACACCGGCGGCGCGCTGCCACGCACGCGACCCTTCC
GGGTGAGCTACGGTACGACTACCCGCGGTGTGGTGGATGCTGTGATTAGCCAGGTCACAGCCGCCGCCGAGCGGGCCGTC
GCGGCCGGGGTGGCCCGCGAGAAGGTGTTGATCGACCCGGCACACGACTTCGGCAAGAACACCTTCCATGGGCTGCTGCT
ATTGCGACACGTGGCCGATCTTGTTATGACCGGGTGGCCCGTGCTGATGGCTTTGAGCAACAAGGACGTTGTCGGGGAGA
CTCTGGGCGTGGATTTGACCGAACGGCTTGAGGGAACGCTGGCAGCCACCGCGTTGGCTGCGGCCGCCGGGGCGCGCATG
TTTCGGGTGCATGAGGTCGCCGCCACCCGGCGGGTGCTGGAAATGGTGGCATCGATTCAGGGGGTCCGGCCGCCGACGCG
CACGGTGAGAGGACTCGCATGACAGCATCGGAGCTGGTCGCCGGCGATCTCGCCGGTGGCAGGGCCCCTGGCGCGCTGCC
CTTGGACACTACTTGGCACCGTCCCGGCTGGACGATCGGGGAGTTGGAAGCGGCAAAGGCCGGACGGACGATTTCGGTGG
TGCTGCCGGCCCTCAACGAGGAAGCGACCATCGAATCGGTGATCGACAGCATCTCTCCGCTGGTCGATGGCCTGGTCGAT
GAATTGATCGTGCTGGACTCCGGTTCCACCGACGACACCGAGATCCGGGCCATCGCCTCCGGCGCCCGGGTTGTCAGCCG
TGAACAGGCGTTGCCCGAGGTGCCGGTACGGCCCGGCAAAGGTGAGGCATTGTGGCGTTCACTGGCGGCCACCAGCGGCG
ACATCGTGGTGTTCATCGACTCAGACCTGATCAACCCGCACCCCTTGTTTGTGCCATGGCTGGTCGGTCCGCTGCTCACC
GGCGAAGGCATTCAGCTGGTCAAGAGCTTTTACCGACGGCCGCTGCAGGTCAGCGACGTGACGAGTGGGGTGTGCGCCAC
CGGCGGCGGGAGGGTCACCGAGCTGGTGGCGCGGCCACTGTTAGCCGCGCTGCGGCCCGAGCTGGGTTGTGTACTGCAGC
CGCTGAGCGGTGAGTATGCGGCCAGCCGGGAGCTGCTGACATCGCTGCCATTTGCCCCCGGCTACGGCGTGGAGATCGGC
CTCTTGATAGACACGTTCGACCGGTTGGGCCTGGACGCAATCGCCCAGGTCAACTTGGGCGTTCGGGCGCACCGTAACCG
GCCCCTAGACGAGCTCGGCGCGATGAGCCGCCAGGTCATCGCGACCCTGCTGTCGCGCTGTGGAATTCCCGATTCCGGTG
TCGGGCTGACCCAGTTCTTGCCCGGCGGCCCGGACGATAGTGACTACACGCGGCACACCTGGCCGGTATCACTAGTCGAC
CGGCCGCCGATGAAGGTGATGCGGCCGCGCTGACCGACACCGCGTCGGCGCCTTAGGGCAAGATCGATGACGTGGCGTTG
GTGTTGGTGTACCTGGTGGTGCTGGTCCTGGTGGCGATCGTGCTGTTCGCTGCGGCGAGCTTGCTATTCGGCCGTGGCGA
GCAGTTGCCGCCCCTGCCGCGGGCGACGACGGCGACGACGCTGCCGGCGTTCGGGGTCACCCGCGCCGACGTCGACGCGG
TCAAGTTCACGCAGGTGCTGCGCGGGTACAAGACCAGCGAGGTGGACTGGGTGCTGGAACGGCTCGGCCGTGAGCTCGAG
GCGCTACGCTCTCAGCTCGGGGGCGATCCACGCCTCGTCGGAAGACGCCGAGGCCGAGTCGTGACGCGTCAAACCCTTCGCG
CGGCGAGACCGTCGTGCACTACCGTTCTGACCGCGTCGAGCGGCGACGGGCTGGTTCGCTGCCCCTGGGCGGAGGTTCG
TCCAGGGCCCGATGCCCAGCTGTACCGCGACTATCACGACAACGAATGGGGCGTCCGCTGTACGGCCGGGTGGCTTTGT
TCGAGCGAATGAGCCTGGAGGCCTTCCAGAGTGGCCTGTCATGGTTGATAATCCTGCGCAAGCGGGAGAATTTCCGGCGC
GCATTCTCTGGGTTCGACATCGACAAGATCGCTCGCTACACCGATACCGATGTGCGACGGCTACTCGCCGATGACGGAAT
CGTGCGCAACCGCGCCAAGATTGAGGCGACGATCGCCAACGCGCGCGCAGCTGCCGATCTGGGGTCGTCCGAAGACCTAT
CCGAGCTGCTGTGGTCGTTCGCGCCACCGCCTCGGCCCCGGCCCGTCGACGGTTCCGAAATTCCCTCGGTCAGCACGGAA
TCGAAGGCTATGTCGCGTGAGTTGAAGCGGCGCGGGTTCCGTTTCGTCGGGCCCACCACCGCCTATGCGTTGATGCAGGC
GACCGGGATGGTCGACGACCATATCCAAGCATGCTGGGTGCCCACTGAGCGACCTTTTGACCAGCCGGGCTGCCCGATGG
CGGCCCGGTGAAGTCATTGCGCCGGGGCTTGTGCACCTGATGAACCCGAATAGGGAACAATAGGGGGTGATTTGGCAGT
TCAATGTCGGGTATGGCTGGAAATCCAATGGCGGGGCATGCTCGGCGCCGACCAGGCTCGCGCAGGCGGGCCAGCCCGAA
TCTGGAGGGAGCACTCAATGGCGGCGATGAAGCCCGGACCGGCGACGGTCCTTTGAAGCAACTAAGGAGGGGCGCGGC
ATTGTGATGCGAGTACCACTTGAGGGTGGCGGTCGCCTGGTCGTCGAGCTGACACCCGACGAAGCCGCCGCACTGGGTGA
CGAACTCAAAGGCGTTACTAGCTAAGACCAGCCCAACGGCGAATGGTCGGCGTTACGCGCACACCTTCCGGTAGATGTCC
AGTGTCTGCTCGGCGATGTATGCCCAGGAGAACTCTTGGATACAGCGCTGGCGTCCGGCATGCCCGTAGCGCTCCGCCGT
TGCCGGGTCGGCGACCAAGGCATTGACCGCCTCAGCCAATCTGGCCTGGTAACCGGTCGCGTCGTCGGCGTCGTAATGCA
```

FIGURE 5(continued)

```
CCAGTGAGCCGGTGATCCCGTCGGCGACCACCTCGGGGATCCCGCCGACGTCGGAGGCCACCACGGCGGTTGCGCACGCC
ATCGCTTCCAGGTTTACGATACCCAGCGGCTCGTACACCGACGGGCACACGAAAACTGTTGCTGCCGAAAGTATTTCTCG
TAGTTGTCCGATGGTAAGCCGGTCTTGGATCCAAAACACGCCAGTGCGATTGCGGGCCAGTTCGGCCACCGCGACGCGCA
CTTCGTCGGCTACTTCCGGCGTGTCCGCAGCACCCGCGCAGAGCACTAGCTGTACGTCCGATCTGAATCGGTGCGCGGCT
GTTACCAGGTGGACGACTCCCTTTTGCCGGGTGATTCGCCCGACGAACACCGCCATGGGCCGGTTCGGATCGACCCCGAG
CTCGGCCAGCACCGACCCGGTACGCGCGGGCCCGGCCGGATACCACGTCTCGGTGTCGATCCCGTTCCGGATGACGTGCA
CCAGGTTCGGATCCAGGCTGGGATAGACCCGCAACATGTCGTTGCGCATTGCAGAACTGACCGCAATGACCGCGTTGGCG
GCCAGCACCGCGGTCTGCTCGACCCATGTCGATACCTGGTAGCCGCCGCCGAGTTGCTCCTTCTTCCATGGCCGCAACGG
TTCGAGCGAATGTGCGGTCAAAACATGCGGGATGTCGTAGAGTATCGCGGCCAGATGCCCGCCAGAGCGGTGTACCAGG
TGTGTGAATGCACGACGGTGGCCGCGCTGGCGGCATTGGCCATCACCAGGTCCGCGGACAAGGTGGACAGCGCCGCGTTG
GCGCTGCCTAGCCTCGGGTCGGGCCGATAGGCAAATGCGCCCGGGCGGGGTGCGCCCATGCAGTGCACGTCGACCGCGCA
CAGCCGGCGTAGGTAGGCAACCAGTTCGGTGACATGTACCCCGGCTCCACCGTAAACCTCCGGTGGGTATTCCCGAGTCA
ACATCGCCACCCGCATACCCCGCACCGTAGTGCGGTGACGGGGCGGCCCGCGTGGCGGGCCGAGGAGGAGGCGGAGGCGG
CACAGCACCCGTCGAACGGGGCCAAACACCTTGACGGACAGCCCGTCAGAGCAGTAGCCAGGGGCGGATTCCCCTTGGCA
GTGGTTTGCGGGGGCCGATAGGTTTGAGCCATGAGAGAAGTGCCGCACGTGCTGGGCATAGTCTTAGCCGGCGGTGAGGG
CAAGCGGCTTTATCCGCTGACCGCGGACCGGGCCAAGCCCGCGGTTCCTTTCGGCGGCGCCTATCGATTGATCGATTTCG
TACTCTCAAACCTCGTCAACGCCCGGTATCTGAGGATCTGTGTTCTCACCCAATACAAGTCGCATTCACTGGACCGCCAT
ATCTCGCAGAACTGGCGGTTGTCTGGTCTGGCGGGTGAGTACATCACCCCGGTGCCGGCACAGCAGCGCCTCGGCCCGCG
CTGGTATACCGGCTCCGCCGATGCGATCTATCAATCGCTGAACTTGATCTACGACGAAGATCCAGACTACATAGTGGTTT
TCGGCGCCGACCACGTCTACCGTATGGATCCCGAACAGATGGTCCGGTTCCACATCGACAGCGGTGCCGGCGCGACGGTG
GCCGGCATACGGGTTCCACGTGAAAATGCGACCGCGTTCGGTTGTATCGACGCCGATGACTCCGGCCGTATTCGCAGCTT
CGTTGAGAAGCCGCTGGAGCCGCCCGGAACCCCGACGACCCCGACACCACGTTCGTCTCAATGGGCAACTACATTTTCA
CGACCAAGGTGCTTATCGACGCGATTCGCGCCGACGCCGACGACGACCACTCGGACCACGACATGGGTGGTGACATCGTT
CCGCGGTTGGTGGCCGACGGTATGGCGGCGGTCTATGACTTCTCCGATAACGAAGTGCCTGGTGCCACCGATCGCGACCG
AGCATATTGGCGCGACGTCGGGACGCTTGACGCGTTTTACGACGCACATATGGACCTGGTGTCGGTGCACCCGGTGTTCA
ACCTGTACAACAAGCGGTGGCCGATCCGCGGGGAGTCGGAGAACCTGGCGCCGGCGAAGTTCGTCAATGGCGGCTCCGCA
CAGGAGTCGGTGGTTGGTGCCGGCAGCATCATCTCGGCGGCCTCGGTGCGTAATTCGGTGCTGTCGTCGAACGTCGTGGT
CGACGACGGCGCGATCGTTGAGGGCAGTGTGATCATGCCCGGCACCCGCGTTGGGCGCGGGGCGGTGGTGCGCCACGCGA
TCCTGGACAAGAACGTCGTCGTCGGGGCCCGGTGGAGATGGTCGGCGTGGATCTGGGAGAAGGACCGGGAACGCTTCGCGATC
AGCGCCGGCGGCGTGGTCGCCGTGGGCAAGGGTGTTTGGATCTAGGTCCGGTTAGCGGCGCGAGCAGACACAGAATCGCC
CATTTCGGCACGAAATTGGGCGATTCTGCGTCTGCTCGGCGCGGTGGGGCGCGCCGGCTAGGGCCCTGGCGGCCCGGGTT
GGCCGAACAGCTGCCCGCCAGCGCCGCCGCGAGCGCCGGCCGCGGCGGCCCCGCGCCACCTCCCACGCCGCCGTTGCCGA
TCAACCCCCGGGCCCGCCGTCTTGGCCCGGTCCGCCATTGGCGCCGTCACCGATCGAACAGTGCCTGGGTGGGAGCGTT
GATCACATTCAGCACGTCTTGCTGCACGCTGCGCCACAGCAGCGTTGACGGCTTCGGCAGCCGCATAGGCCCCGCCAG
CGCCGGTCAGGGCTTGTACGAACTGCTGATGAAACGCCGTCGCCTGCAAGCTAAGCGCCTGATAGGCCTGAGCGTGTCTG
GCGAACAGTGACGCCACGACCGCCGATACTTCATCGGCACAGGCGGCCAGCATCGCGGTGGTTGGGCGTGCCGCGGCGGC
ATTGGCCGCGCTCAATGCCGAGCCGATGCCCGCCAAATCCGTTGCCGCCGATGCCAGCACGTCCGGGGCGCCACCAGATA
CGACATGGCCACACCTTATCGTGGGCTCGTTACGGCATGCGGTGTTTTCGACGGACTCGTCACCGACGCCGCGCGTGTGA
CGCGCGCCGTCAGCCAGCGCTCGGCAACCCGGGCTACCCAGGGACCTCCGGTATCAGCAGGTGCGCGTCGTAGCGTGGGC
CCCAGTGCAGCGTGACACGACCACGCGGCGGGCGTGGGTAGGCGGCCGGGAATTGGCCGGTGAGCGGGTTGCGGGGGGAC
AACCAGCGTCCGCCAACCACCAGTCGTAACTGTTCGCCGGCCGGAACAATGTCGCCGACGGGCCAAGCGCGACATCGAC
GGCGACGACCTCGCCGGCGGTGACCGGCCGGGGCCGAGCACACGCCGGGACCGGCTCCCATGGCTGCGAGAGCTCGGGGT
CGAGCTCGCGCAGCGAGACCCGCTGCCAGCCGGTGGTCACCCGGTCACGGCCCCAGCCGTAGGACCCCTCAAACGCAACG
AACTGGCCATCGCGCCACTTCTCCACTCCGACGAACAGGTTCGCGTCGTCGCAGCCATCCAATTGAACCCACAGGCGGGC
GGCCATCGGGCCGGTCAACTCGATGTCTTCGGGGATCGTCCAATTGAATGCTGCTGCCCGAGAGCGAGTTTGGAACCTGA
TGCTGCCCGCCGTCGGCGGCGGCTCGGTTGCCAGCAGCCCCGGCCCGGCGAGATACATTGGCCGCCAACGCGTGCCGGCA
AGCGGCCACTGGGTCTCTTCACGCACCGCGGTGATGGTGTCGCGATCCTCACGCACCTCGAGGCGAACGCTGCGCGAACC
GGAGGAGCCGGCCAGCGCGTCTCGCAAGAACTTCAGCTGCTCGGACAGCGCGGTCGCTGAGTAGAAGGTCTCCCATTTGC
CCCCGCGATGGGTATACAGCCGGGCGTGACCGCAGCCGCTGCGGGTAAAAGCGCGGATCGACCCGCGGCTGTGCAAGTTG
TTGTCCGAGAAGCTACCGCAGACCAGCATCGGAACCTTGATCGCCGACAGGTCGGGTACTCGCGAGCGCCAGAAATCGTC
GCGCAGCGGGTGAGCCTCTTGCATCTGCTCCATGTCGTAGGTCTGACGTGTGCCGACGTCGCACCCCGCGCGACCACAGCC
GGGTGAACCCTGACTCCCGGATGCCGCCGGGAAAGGCCAAGTCGCGGTAGGCGTCGGTGAAACCCTCCCACGGGCAGATC
GCCCGCAGCGCCGGCGGTTGCAGCGCGGCCACGGCGTACTGGCTAATGGCCAGATAAGACACCCCAGCATGACGACGCG
CCCATCACTCCATGCCTGGTCGGCGAGCCATCCCACCAGGTCGTAGGTGTCCTCGGCTTCCTGGTGTGACAGCAGGTCTC
CGGTACCGTCGGAGCGGCCGCAGCCGCGCGAATCCGCATTGACCACGACGAAGCCCTGCGCGGTCCACCACGCCGGGTCC
GGCGCCTCCCAGCCGGTCAGCGCCGAGAAGGTCAGCGGCTTCGGCTGGCGCAGCATCCGGTATTGTGGTGAGAACGTCCA
```

FIGURE 5(continued)

```
CCGGTTGCCCCGCCGCCGCGGCAGGGCGTCCTTGCCGTAGGGATGGATGCTCGCGATCACCGGCCTAGCCCCACCTTCGG
CGCTACGAAAGACGTTGATCCGCAGCAGCGTTCCGTCGCGGGTAGGCACCTCGACGTCGCGTTCTATGACGACGTCGGCC
GGCGGATCGGTGACGGTGATCGGCGGCTTGGCGACGCCGCGAACCCGCTCCAGCGCATACCGGAGAGCACCGGGACGTCG
CCACGGCCGGTCCAAGGCAGGTGACGGGTTTCTGGCCACGCCCGTTACCCTAAAGCTATTCGACCGCTACCACACGTAGG
GCACCAACCGGTAGCGCACCAGTTGCCGGTATTCGCGGTACCCGCTGAGTTCTTGCGTCAGTAGTTTTTCCTCGTCGAGG
ATGCGGAACACCAACACCAGTGTGCCGGGGACGAGGATGAACATCGCCCAGTAAGAGCCCAGTGCCAGCGGTATGCCTGT
CATCATGACCACGTTCCCGGCGTACATCGGGTGTCGGACAATTTTGTAGAGACCGTCGGAGGCCAATATCTGGCCCGCCT
CCACCCTGACCGTCGAGGCGGCATACCTGTTCTGGATGACCACCAGCATGGCGATGCCAAGGCCCGTCATCACTAGGACG
TCGCCGATCACGCACACCGCGGCTGGCACTGACGACCAACCATAACGATGGTCGCACGCGCTCAGCACCATCATCGCGAA
GAACCCCAGAAAAGCGCCGATGACGATGAACTTCTGAATCGTTCGGCCCTCCGCGAGCGGACCGCTGCGCATGCGACGTT
GAAGGGCCGCGGGATCGTTGCGAGCCAGATAGATTGTGGGGCCAATCGTGGTGCTCACAAATGCGGCGAGGAACACCCAC
GCCTGCCAATAGTCGAACGTGCCGGCTGGCCCGAATAGGAGCGCGCCGAAAACGACGAGTCCTAACACGCCCCATATGAA
TATCTTCAGCCCAATGTGCATGGCTCCTCCTAGCAGCGAACGTCACGCCGTCGGAAGGCCATGGCGCCCAGGGTGATCAG
GGCTGCATCTATGGCCAGCAGCCACAGCAACGGCACCGCGGTGAAATCGCCGCCGCCGACCCGCGGGATGTGGGCGAACG
GCTCCAGGTTGAGCAGCATCTGCGGGAACCCCGCCAACGAGCCGAGCAGGTACAGCGCGATGAACCCGACCAGCACGCCC
CACGCCACCGGCGTGAACCGCGGCGCCAACCCGAACAATCCCACGGTCACCGCCGATAACAACCACACGGCCGGCAGTTG
CACGGCCGCGGTGCCGACCACGGTGGGCAGCTTGCCGCCGACGTCACCGACGGTCATGCCGTAGGCGAGTCCGGCCGCCA
CGCCGGAGATCAGGGTCGCCACCGCCGATCCGGCCAGCGCCATCGCCAGATGGCTTGCCAGCCAATGGGTCCGGGAAACC
GCCCCGGCGAGCAGGGTCTCGGCCCGCAGCCCGGTTTCCTCTTGGTGCAGTCGTAGGGTCAGCGAGACGGCGAATGCGGC
GGCGACCATGCCGATCATGGTGAAGGCCAGCGCAAGGAAGGCCTGTTCCAGTGCGCCGGTGCCGCCCATCCGGGTGACGA
TGTCACGCACCGCGGTGTTATCGCCCAGCTGATCCCCGATGCCGTCGCACCACACTGCCCATCACCAGCCCGTACAGGCAC
AGGCCGACGGTCCACAACAGCAGGGAGCCGCGATTGAGCCGCCATGCCAGCCCGAAGGGCTCGCTCAGCATGGGCCCGGC
GGTGCCGGCGCCGGGGCGTTCGGCGATCAGTCCGGCACCGACATCACGGCCGGCGCGTAATCGATAGGCCAGCACGGTAA
GCACGGCCGCGGTCGCCAGCGACAGCAGCAGCACCCACCAACGCTCTCCCGCGTAGGGTCTGACCTGCAGCGACCACCCC
AGCGGCGAGCACCAGGACAGCGTGCCCGAGCCGGCATCACCGATGGCACGCAGCGCGAACGCGGTGCCCAGGACGGCGAA
CGCGACCGCGCGGGTGAATCGGGCGCTCGGCGACAGCTGCGCGGCCACCGCGGCCACCGCCGTGAAGACCATCCCGGAGG
CCGCCAGCGCCACGCCAAACGCTACCGACCCGGCCGGAGCCACATCGGTGGCAAGCAGACCCAATGCACCGATCGCCCG
GTCGCGATCGACGCCGAACGACAGCAGCAGCGCCGCGGTGAGGTTGGCGTAGCGCCCGACCACGGTCGAATCGATCAA
TTCGGCACGGCCGCTTTCCTCGTCCGCGCGGGTGTGCCGAATCACCGTGAGGATGACCGCCACCGCGATGAGGGTGTGAA
ACATCCCGGCTTTCCAGATTCCGACCGCACCCAGGCTGTCGTTGTAGACCGGCCCGTAGAGCGCGCGCTGTGCCGGCTG
GCCATAATGGCGGCCGCCGCGGCGGCGCGGGCGGACCGGTCGGGGTAAACCGTTTCGACGCTGGCGATGTACACGGTGGC
CAGCGGCACCGACAGCAGCAGCACCCACAGCGGCAACGACACCCGGTCGCGGCGCAGGTACAGGCGCAGCAACCCCAGTG
TGCCGGTGAAGCCCGAACCGCGGTGTGGTGCACGGTGTCCTGCGGGTCTCGCGCGATCGATGACCGTACTGCTCACGGCG
TTGCCACCTGTTGCTCGGCTGCGACCTCGGGGCCCAGCTGTAGTGGCGCAGGAACAGCTCCTCCAGGGTGGGCGGCTGA
CTGACCAGGCTGCGCACACCGGCGTGGCCGAGCACTTGGATGAGTTCTCTCAGGCTTTCGCTGTCGACCTGGGCGCGCAC
TGTGGTGCCCTCGATGCTGATGTCCTCGACTCCCTTGATTTGGCTGAGGTCTCCTGGATCACCGATCATTTCGGCCTTGA
TCGAGGTGCGGCTGAGGTGCCGCAAGGCGTCTAGTGAACCGCTTTCGACGGTCTTGCCGGCTGGATGATGGTCACCTTT
TCGCACAGCGCTTCGGTCTCGGCCAGAATATGGCTGGACAACAGCACCGTCACACCGCGTTGGCGTGCTTCGCCGATGCA
CTGCTGAAACACGTTTTCCATCAACGGGTCCAGGCCGCTGCTCGGCTCATCCAAGAGCAGCAGAGTGGCGTGCGACGACA
ATGCCGAGATCAGGGAGACCTTTTGGCGGTTGCCCTTGGAGTAGGTGCGCGCCTTCTTGGTTGGGTCCAGGCCGAAGCGC
TCGATCAGTTCCGCGCGACGAGCGTTGTCGATGCCGCCTCGCATGCGGGCCAGCAGGTCGATGGTCTCACCCACCGGTCAG
CGACGGCCACAATGTGACATCGCCTGGAACATAGGCCGATGTGGCGGTGCAGGTCGACGGCGTCGGTCCAGGGGTCACCGC
CCAGCAACCGCACGCTTCCGCCGTCGGCCTTCACCAGGCCTAGCAGGATGCGCAGGGTCGTGGACTTGCCCGCGCCGTTG
GGGCCGAGGAAGCCGTGCACTTCGCCCTCGCGCACCGTGAGGTCGAGCCCGTCGAGCGCCCGCACCGACCCGAAGTGCTT
GGTCAGTCCGCGAATCTCGATGGGCACCTGGTGGTTGTCAGCCGACATGTGCTTCTCCTTGTTGAGCTTCGGCCAGGAAG
GCCTCGTACATGGCGCGGTCGGCCAGCAGGCCTTCGGTGTAGACCTCCAGGGAAGGCAGCACCATGTCGTGCGCGTAGTC
GCGTAACGCTGCACGGAGATCGGTTGGGTTTTCGTGCATTTGCAGATAAAGCAGGAAGCCTCCGCCTCCGGTGATCGCCA
GAAACCGAGCACGGGCGCGCGGGTCGCGGCTGGGCTTGACCGTACCGGCGCGTACTCCTTCGTCCAGGTACTCCTCGGCG
TTGTCGATCATCTTCTGCCACAGCATCTTCGCCAGCTCGCCGCCGGATTGCATGCTGCGCACCAGGTATGCCATCAGCGG
TGCGTAGGATTCGATCTCGGCCATCTGCGCGAGCCAGGTGGTCGGGTCGTTGGACTTCAGTGCCGCAGCCTTGCTGCTGC
GGATCTCTTCGGCGACGAAGTCGTCGCAGGCCTTGCGCAGACCTTCCTTGGAACCGAAATGGTGGATGACCAATGCCGCG
CTCACCCCCGCCGCTTCGGCGATGGCTCGCAGCCCGACACCGAATCCGTGCCGACCGAACTGTTCGATGGCCGCCTCTCT
GATCCTGGCGTGCGCGGTCAGATCGGCTGAACGCATGTTCAGGATATTAAACGTACGTTCATCCCCGGTCAAGGGAGGGC
GCCGTTGGGAATCCGTGAAGGCCGCGAACTTTGCCGAGCAGACGCAAAATCGCCCTGGAACGCACGGTTCAGGGCGATTT
TGCGTCTGCTCGCCGAATTAGTCCCGCACGGCTGCCAGCACGCCGTCGCCCAGCGGCACCAGTGCCGGAGTGAGCCGTTC
ATCCTCGGCGATAAGCCGGGCCGCCTCGCGAACCGCGATCACCTCGGCGTCGCGCGCCCCGGGATCACCGGCCCGACCGC
```

FIGURE 5(continued)

```
CCAGCGCCGCCCGGTGCACGACGATGACCCCGCCGGATCGCAGCAGCCGCACCCCCTCGGCGACGTAATCTGGCTGGTCG
ATCGGGTCGGCGTCGATGAATACCAGGTCGTAGGATGCGTCGGCGAGCCGGGTCAGCACCTCTTGGGCGCGGCCGCTGAT
CAGCCTGGTACGCGACGGCCCGATGCCCGCCTCGGCAAAGGCCTGCCTGGCAAGGCGTAGATGCTCGGGCTCGATATCGA
TGGTGGTCAAGACGCCGTCGTCGCGCATGCCCGACAACAGCCACAGGCCGCTGACGCCGGCCCCGGTACCCACTTCGGCC
ACCGCCTTGCCTCCGCTGAGCTTGGCCAGCAAGCACAGCAACGCACCCACCGCCGGTGTTACCGCCCCGGCCCCGATGTC
GGTTGCGCGCTCGCGGGCGCCGGCCAGGATCACGTCTTCAGATATTGACCCCTCGGCGTGCGCCCAGAGTGATTCGCCTC
GGCTGGGGGCCGGCTGGCCAGGCATGTCGTCGTGTCCGGGGGTGCCGTCCATGCCCGCAGCGTATGTCCAATTGGCGACG
CCGTCGGGCAGGCGCGCCTGGTTCGAACGCCGGCCGAGCACCGAGCTGGACGCTTGCGGCTGTACCCGACACGCCCGGCG
TGCCGGACGCGACGAAGGTCACTTTGACTCGATATTCCCTGGACAGCGCAGGTAACGGTATGGTTTCTAAGCCAAAGCTC
AGATTGCTCATATATGGCCCATACGCCGGTACGCGACGGTAATTCCCATGGAACTCCTCGGCGGACCCCGGGTTGGGAAT
ACGGAATCGCAACTTTGCGTTGCCGACGGTGACGACTTGCCAACTTATTGCAGTGCAAATTCGGAGGATCTCAATATCAC
GACCATCACGACCTTGAGTCCGACCAGCATGTCTCATCCCCAACAGGTCCGCGATGACCAGTGGGTGGAGCCGTCTGACC
AATTGCAGGGCACCGCCGTATTCGACGCCACCGGGGACAAGGCCACCATGCCGTCCTGGGATGAGCTGGTCCGTCAGCAC
GCCGATCGGGTGTACCGGCTGGCTTATCGGCTCTCCGGCAACCAGCACGATGCCGAAGACCTGACCCAGGAGACCTTTAT
CAGGGTGTTCCGGTCGGTCCAGAATTACCAGCCGGGCACCTTCGAAGGCTGGCTACACCGCATCACCACCAACTTGTTCC
TGGACATGGTCCGCCGCCGGGCTCGCATCCGGATGGAGGCGTTACCCGAGGACTACGACCGGGTGCCCGCCGATGAGCCC
AACCCCGAGCAGATCTACCACGACGCACGGCTGGGACCTGACCTGCAGGCTGCCTTGGCCTCGCTGCCGCCGGAGTTTCG
TGCCGCGGTGGTGCTGTGTGACATCGAGGGTCTGTCGTACGAGGAGATCGGCGCCACACTGGGCGTGAAGCTCGGGACGG
TACGTAGCCGGATACACCGCGGACGCCAGGCACTGCGGGACTACCTGGCAGCGCACCCCGAACATGGCGAGTGCGCAGTT
CACGTCAACCCAGTTCGCTGAACTACTCAACGGCCGCCGAGCGCGTCGGTTCGGCTACCGCATGGTTGCCAATCGGTCCC
GAATCCTGGGGTTTTACCGGCTGGCGATGGTTTTCCGGCACCGCGCCGCGCTACATTCGAGATACCGGTGGCTCGCTAGG
TGGCGGAAGGAGGTGGTGATGGCCGACCCCGGAAGCGTGGGACATGTGTTCCGGCGCGCGTTTTCCTGGCTCCCGGCGCA
GTTCGCCTCCCAGAGTGACGCGCCGGTCGGCGCGCCGCCGGCAGTTCCGTTCCACCGAGCACCTGTCAATCGAGGCCATCG
CGGCTTTCGTCGACGGCGAGCTGCCGGATGAACGCGCACTTGCGGGCCGCGCATCACCTTTCGCTGTGTGCCCAATGCGCG
GCCGAAGTGGACGACCAAAGTCGTGCCCGCGCCGCTCTGCGCGATTCCCACCCGATCCGCATCCCCAGCACGTTGCTCGG
ATTACTGTCCGAGATCCCGCGTTGTCCACCTGAAGGTCCATCTAAAGGTTCGTCTGGAGGTTCATCCCAGGGCCCGCCCG
ACGGGGCTGCGGCAGGCTTCGGCGACCGCTTCGCTGACGGCGATGGCGGGAATCGGGCCGGCAATCGCGGGTGCGTCGC
TAGCCGGTGAGCCACTTGTCGCAGCGCATGGCGGGGTTGCTGCGAGTTCATGGCGAGTGGTCGCGATCCGTGGATACTAG
GGTGGACACGGACAACGCGATGCCTGCACGTTTTAGCGCCCAGATTCAGAATGAGGATGAGGTGACCTCCGACCAAGGCA
ACAACGGCGGCCCGAACGGCGGAGGCCGCCTGGCGCCGCGCCCGGTTTTTCGGCCACCGGTCGACCCGGCGTCGCGTCAA
GCGTTCGGGCGTCCGTCCGGGGTCCAAGGGTCCTTTGTGGCCGAGCGTGTGCGCCCGCAGAAGTACCAGGACCAGTCTGA
CTTCACACCGAACGATCAGCTTGCTGACCCGGTGCTTCAGGAGGCGTTCGGTCGTCCGTTCGCGGGCGCCGAATCGCTGC
AGCGCCATCCCATCGATGCCGGAGCGCTGGCAGCTGAGAAAGACGGTGCCGGCCCCGACGAGCCCGACGATCCGTGGCGC
GACCCCGCGGCCGCGCCGCGCTGGGGACGCCAGCGCTAGCCGCGCCGGCACCGCACGGTGCGCTGGCCGGCAGCGGCAA
GCTGGGTGTGCGCGACGTGCTGTTTGGCGGCAAGGTGTCCTACTTGGCGCTGGGCATCTTTGGTCGCTATCGCACTGGTGA
TCGGCGGCATCGGCGGTGTCATCGGCCGCAAGACCGCGGAAGTAGTCGATGGCGTTCACCACGTCGAAGGTGACCCTGTCG
ACCACTGGCAATGCCCAGGAACCGGCCGGCCGGTTCACCAAGGTGGCGGCCGCCGTGGCCGATTCGGTGGTGACCATTGA
GTCGGTCAGCGACCAGGAGGGCATGCAAGGTTCCGGCGTCATCGTCGATGGCCGCGGCTACATCGTCACCAACAATCACG
TGATCTCTGAGGCGGCCAACAATCCCAGCCAGTTCAAGACGACCGTGGTGTTCAACGACGGCAAGGAGGTGCCCGCCAAT
CTGGTGGGTCGTGACCCCAAGACCGACTTGGCCGTCCTCAAGGTCGACAACGTCGACAATCTGACCGTGGCCCGGCTCGG
TGATTCCAGCAAGGTACGGGTCGGTGACGAAGTCCTCGCGGTCGGCGCGCCCCTGGGGCTGCGCAGTACGGTGACCCAGG
GCATTGTCAGCGCGCTACACCGCCCCGTTCCGTTGTCGGGCGAGGGCTCTGACACCGACACCGTCATTGACGCAATTCAG
ACCGACGCCTCGATCAACCACGGTAACTCCGGCGGTCCGCTAATCGACATGGATGCCCAGGTGATTGGCATCAACACCGC
CGGTAAGTCACTGTCGGATAGCGCCAGCGGGCTGGGCTTTGCGATCCCGGTCAACGAGATGAAATTGGTGGCAAATTCTC
TGATCAAAGACGGAAAGATCGTGCATCCGACGTTGGGCATCAGCACCCGGTCAGTAAGCAACGCGATCGCGTCGGGCGCG
CAGGTGGCCAATGTAAAGGCGGGAAGTCCCGCGCAGAAGGGCGGGATCTTGGAGAACGATGTGATCGTCAAGGTCGGTAA
CCGCGCGGTCGCCGACTCCGACGAGTTCGTCGTCGCCGTGCGCCCAGTTGGCTATCGGCCAGGACGCTCCGATAGAGGTGG
TCCGCGAGGGTCGGCATGTGACGCTGACGGTGAAACCGGACCCCGATAGCACCTAGAGTGTTCGCCAACATCGGTTGGTG
GGAAATGCTCGTCCTCGTCATGGTCGGGCTGGTGGTGCTTGGCCCGGAGCGGCTCCCGGGTGCCATCCGCTGGGCGGCAA
GCGCTCTGCGGCAGGCGCGCGACTATCTCAGCGGTGTGACCAGCCAGCTACGTGAGGACATTGGACCCGAATTCGATGAT
CTGCGGGGACATCTCGGTGAGCTGCAGAAGCTACGGGGAATGACTCCGCGGGCTGCGTTGACCAAGCACCTACTGGATGG
CGATGATTCCCTGTTCACCGGAGACTTCGACCGACCGACGCCGAAGAAACCGGATGCGGCGGCTCGGCGGGGCCGGACG
CTACTGAGCAGATCGGTGCGGGGCCCATCCCGTTTGACAGCGATGCCACCTAGATCGGTGACGGCCGGCGGTCGGGCCCG
GCGAGCTAACACCCGAGCAACGGCGGCAGGCCGGCCACCGAGTCATCACGTGGTGCGGCCGGGTCGCGCTGGCGCCGGC
CAGCCAGCGATCCAGCGTTTGCTGGCGGAACTTGCCGGTGCGCACCAGCACACCCGTCATGCCCACCGCCTGGGCGGCCA
GCACGTCGTTGTGCAGATCGTCGCCGATCATGACCATCTGCTGTGGATCGACACCGACGCGGTCGGCGGCCGCCAGGAAT
```

FIGURE 5(continued)

```
CCCTCGGCCGCAGGCTTGCCGATGGCGGTGGCGGTCTTGCCGCAGGCCTGTTCCATTCCGGTCAGGTACATCCCGGTGTC
GATGCGCAGCCCGTCGGTGGTGTTCCAGGTCATATTGCGGTGCATCGCCACCACCGGAACGCCGTCGAGCATCCACCCAT
AGACCCGGCTGAGCGTGCGGTGATCGAACTGGGGGCCGGCACTGCCGAGCACGACGACGTCGGGGGCTTCGGGGCAATCC
TCGGGACCGATCTCGGTCGACAAGACGACGTCGATGCCGGGCAAGTCCTCGGTGATGTCGCCGTTGTTCACCAGGAAGCA
CCGCGCGCCGGGATAGGCGCCGTGCAGGTACTCGGCCGTCAGCACCCGGCCGTGATCACGTCGTCGGCGGCGACGGGGA
TCCCCGCGGCACCCAGCGCCTCGGCGATCTGCCGGCGGGTGCGCGTCGTGGTGTTGGTCAGATACGCGCAGGCGATTCCC
CGATGGGTCAGTTGCCGCACGGTCTCGGCGGCCCCGGGAATCGCGCGCCACGACAGCACCAGCACGCCGTCGATGTCGAA
CAGCACCGCCGCGGCCATCAGATGCGCCACGTCCACACGATATCCGTCAGTTAGACCGTCGACATCGACACCAGCGCGGA
AAAACCCCAGTGAGCATCGCGCTGACGTCGATCTCGACGGTGAGGTTCATCCTGGCTCAGGATCCCTCAAGATCCGTGGC
GCAACCACACACTGTCGGCCACCCAGGGCGAACGCGGCGCCGGCCACCGACCACGCCAGCTCCGCGGGCACATCGAGCACC
TGATAACCCTTGCGGCCCGCCACGGTGGCCGCCACGAGCGTCGCCACCCCCGCCCTCCGCTGGAACAGTGTCTGGCGCAC
CGTCCAGCCGATGATGCCGGTGCAGGCGATGCAATCGCGGCGACGCTGTAGGCTGCCGGCGCGCGCAACCAACCAGCCGT
CGGCGACGCGGTGCCCGAGTGATCGGACCCGATCGACGGCCAGCCCAGCGCAACCCGCGGTCAACACCGCCCACAGTGTC
CACGCCCACCCCGGCACGCCGAGAATCGGCGCCGCTGCGATCAGCGCAACTCCGGCCAGCGTCGGGACCAACAGCGCCCG
GGTCCACCTGCGCCGGGCGGCGGCCGGGCCGTGCCGGCGCAGCGGCCCCGCTGCCGCGTCGGTGTTGTCGATCAGGTCGG
TCAGCACGGCCGTCGCGGTCTCGAACGGACATGGTGGCAGCAGCATCGACGACTGGCCCTCGCCATGCACGCCGGTCATC
ACTGCGTCCAGCCGAGCACCGCGCAATAACCGCACCAGCAGTGGTTCACGCAAGGTGGCGCCACGCAGCCGGCGCATGTC
GTAGGTGTGCTCGCGCACCCGCAGCAGCCCGTGCCGCAGGTGTAGCACCCCTTCTTGACCGCTGCCGCCGCGGCGCAGCA
GCAGATTGCCGTAGGTCAACCAGGAGAACAGCACCGCCAACAGTGCCGATACACCCACCACCAGCAGCACAGTGACCGCC
ACCACCAGTACCACCCCGGCGCGTTGCGCGGCGTCCACCGCGGACCTGGCGAAACCGGATTCCGGGAGTCGCACGGCCAG
TCCCGTTTGGTAGCCAAGCCCGATCACCGCCCCGATCATCACCAGGCCCGAAAAGCTCAGCGGCGCATACCGCAACCACG
ACGACTGCCACCGGGCCGACACCCGACCGGTCGGCTCGACGGGTGCCAGCGACTCGGCCAGCAGCAGCCGCAGCCTG
GGCACCCGTGCCGAGTCGACCGCCTCCAGTTCGAAGGCGGCCTCACCGCGGGCCTCCTGGCCGGTGCCCACCCGCAGCAC
CGTCAACCCCAACAGCCGGTGCAACAGCCGCGCCTCGGTCTGCACCGAGCGAATCCGGTTGCGCGGCACGGAGACCGCGC
GCCGGCTGAGTATGCCGGTACGCAGCGACACGTTTTCGTCGTCGATGCGGTAGGTGGTGAAAAACCAACGCAGCACGCCG
AATACGACCGTCACGCCGAGCGCCGCCAGCGGCCAGACCGGGTTGCCGGTTGCCGACCCCAGCACCACGGACCCGATGAG
TACCGGGAGCTGGCGCAGCATCTCGTGCACCGGATGCACCAGCAGCATCCGCGGGCTGAGGCGGTGCCAATCGTGTGGCC
GGTCGGTCATGTCGCGTCCTCGCCGCGCAGCGCGGCGATGTCGGTCAGCTGCGCCACCACCCGATCGGCGACGTCGGTGT
CCAACGCCTCGATGTGCACCGCGCCCGCCGAGGACGCCGTGGTTACGGTGACGTTGGCCAGCCGCGAACAGCCGGTCCATC
GGGCCGCGGTAGGTGTCGACGGTCTGCACCCGGGAAATCGGTGTGATGCGGCGCTCCTGCACGAGCCAACCGGTGCGGGT
GAATACGGCCTGCGGGCTGATCTCCCAACGGTGTACCCGGTAACGCCAGAGCGGGACCACCCCGATGTGCACCACCATCG
CCACCGCGGTGAGAGCGGCCGCGGCCAGGTGCGGCCAGGGCGGCTGGGGATGCACCGCCCACCACACCAGCTGCGCGATC
ACCGGGAGTATCCAGCCCAGCGACGCGGACAGCGCCCACATCACCGGCGCCTGGCTGCTCGGTCGATGGGCCGGCTCGGC
GAGCGCGAGGTGATTTCTCTGCGGTCCGGTTGCGCTTGGCACATTTCGAGCATGGTCCAACGGAAACCGAACAGTGAT
CGGGGGTCGTGGTTATCGTTTGAGCTAGCGCTCAACAAGATGCGTGCCAACTCACCCTGCCCCGGGGAGGCGCGATGAGT
CGACAGTGGCACTGGCTGGCAGCGACGCTGCTCCTGATCACCACCGCCGCGTGCAGTCGTCCGGGCACCGAGGAACCGGA
TTGCCCGACGAAATAACCTTGCCGCCCGGTGCTACGCCCACCACGACCCTCGACCCGAGATGCATAGTGCGCGCGACCA
CCACCGGCACAGCCGACGGCGATGCGGCGTCGCGCTGGACCGGAACCGTGCGGATCGCCGGGTTCTATGCCTCGATCTGC
AACGCGGTATGGGACGGGAACGTCAGCCTTGCGGGAAAGGACGAGCTGACCGGCAAGGCTACGCTTATCCTCGTCGAAAC
CAGTTGCCCGGCAAGGTTGTCGCCGGCGAACTCGTGCTGAAGGGGAACGTCGGTTCGGACAGCCTCGCGATCACCTGGG
CGCACCCCGAACTCCCGCAGCGGGCGTTCGACCTCGGCGCCGGACAGGGCACGATCCGCCGATCGGGCGACCGTGCCGAG
GGAACGTTCAACTCGGATATGGGTGGGGGCACCGAGTTCTTCTTGACGTGGTCGCTGACGATGCGTAACTGACGATCACA
ACGTGCCCACCAAAAACAGAGTAGACAACAGTCGACAATTCCCTTGTACTCCGGCGCTATGAAGTCGATCTCCGTCGGTG
AGCTGCGCCAGAATCCCGCTCCCATGATCGCCGACCTCGAACGGGGTGAGCCATACGCGCTGACCCGCCACAACCACCGG
ATCGGAACGATCATTCCTGCCGTCTCGTCGGCAACACTCATTCCCGGAAAGCCTAGTACGCCGAGCAGACGCAACGGCA
CCCAATTTCGACCAGAATCGGGTTCTTTTGCGTCTGCTCACGCGGTCAACGCTAGCGTCGTGTCGGGTCCAACCCCAGCG
ACATGCCCGCCAATCCGCGTCGTCGAGTCGACAAGCCGTCGGCGATGCTATGCAGTTCCTTGCCGATCGCCGAGTCCGGC
GAGCTCAACACGAGCGGTACGCCCGAATCGCCGGCGGCCACCAGTGCGGGGTCCAGCGGGATCTGACCCAGCAGCGGCAC
GTCGGCGCCGACCGCACGCGACAACCGCTCGGCGACCAGCCGGCCACCGCCCTCGCCGAACACCTGCATCGTGGTGCCGT
CCGGCAGCGTGAGCCCCGACATGTTCTCCACGACGCCGACGATGCGTTGGCGGGTTTGCAGCGCGATGCTGCCGGCCCGT
TCGGCCACCTCCGCGGCGGCCAGCTGCGGGGTGGTGACCACCAGGAGTTCGGCGTTGGGGATCAGTTGAGCCACCGAGAT
GGCGACGTCGCCGGTTCCGGGCGGCAAGTCCAGCAGCAGCACGTCCAGATCCCCCCAGTAEACGTCGGCCAGAAACTGCT
GCAACGCCCGGTGCAGCATCGGCCCGCGCCCACACCACCGGGGTGTTGCCCTGGGTGAACTGGGCTATCGAGATGACCTTC
ACCTGGTGGGCGATCGGCGGCAGGATCATCGACTCAACCTGGGTAGGCCGGTCGGTGGTGCCCATCATCCGGGGATAGA
GTGGCCGTGGATATCAGCGTCCAGCACCCCGATCGACAGGCCGCGGACGGCCATCGCGGCGGCCAGGTTGACCGTGACGG
TGGACTTTCCGACTCCGCCCTTACCGGAAGCCACGGCATACACCCGGGTCAAGGAATCGGGTTGCGCGAACGGGATGACG
```

FIGURE 5(continued)

```
GGTTCGCGGGTATCGCCACGCAACTGCTTACGCAGCTCGGTGCGCTGCTCGTCGCTCATCACGTCCAAGCTGACCCGCAC
CGCCGAAGTGCCTGGCACGTCGGCGACCGCCCGGGTGACACGCTCGGTGATTTCGGACTTCTTCGGGCAGCCGGCGATGG
TCAGGTAGATCTCGACGTGCACGCTCCCATCCGGGCCGGTGTCGATGCTTTTGACCATCCCCAGTTCGGTGATGGGGCGC
CGCAATTCGGGGTCGATTACCTTGCCCAGCGCGGTGCGTATCGCCGCGTTCAGGTCGCCATCACGAGTTCCGGACATCAC
CGCCGAGTGTAGGCGGCTTGGCATACGGCCGAGTGGTCAGCCGGCAGGAGCCGGCGCCGGCGGCTGCCAGGCCCGCGTCGC
CAGGCGGGCCGGCCAATGGATCCGGAGGTGGGGGAGCGGCAGGTAGGAATGGAGGTGGGGGAGCGGTAGGCGGGAACGGC
GGCGCGCCCACTGGCGGGCCATGTGAGCCAATGCAGATCAGCGTGCAGCCGGGCATCGGCGCCGATGGTCAGGTGCCAT
CCACGGGAACATCGGCGGTGGATTGAGCGCCGCCTGGCGCGGGGTCAAGTCGATCAGCGGCAGGTGCGCCATGGGGCCAT
CGGCGGTCAGGCCGTTGACATTGATCGGCAAGCCGGGCCCGAGACCCTCCGGATTCTCGAGGTGCGCGTCGCCGAGTGGT
GGTGGCGGACCGGTGATCGGGGGCAAGTCAACCGGGAACACACCGGTGGCGTAGCCGGCGGCCCAGCCCAGTACGTTCTG
GGCGTAAGGCATCGAGTTGTTGTAGCGCAGGAGCGCGGCCATGACCTGCGCCGGGTCGCGCAGGTTGAGCCCACCGCTAC
ACAGGTAGCGGGCTGCGGCCAACGTGGAGTCGAACAGGTTCTGCGGGTCAGCCACACCGTCGTCATCGCCGTCGGTGGCG
TACCGAGCCCAAGTGCCGGGCAAGAACTGCATTGGCCCCATCGCGCGGGCGTACGTGACGCGATTGCCGACGCTGCTTTG
GATGATGATCTCGTTGCCTGGCAGGGTGCCGTCCAGCGTTGGGCCGTAGATCGGCTGGATCGCGGTGCCGCGCGCGTCGG
TGGCGCCGCCGTTTGCGTGCATCGACTCGATGCGCCCAATCCCGGCCAGCAAGTTCCAACTGACGCCACAGCCAGGGGCG
GCAGCGGCCATCTTCAGCTCGGCGTTGCGGTAGGCGGACAGTGCCATGGCCGGAATGCCAAGCGCACCAGGCGAATTCAC
GATCATCGGTGGTGGTGGAGCCGATATGGTAGCTACCGCCACGCGGAAGCTGGTCGGCGGGCGCTTCATGGCGATGACGA
CCGGACCGGACAGGTCTATGCCGGACGCGGCGACCGCGGCCACCGGGGTGATAACGGCGTGCACCGGCGCGGTTCTCCCG
GGGAATACCGGAGCCGCGCTGCCGACCGCACTGGCGAATACCAACGGGCAATCGCTGCCACGCCGAATGCCGGCGCCCG
CGTTAGGCGACAAGCTCCCCGCCGCACTGCAGCGACGGCCGGGCGTGCACCCCAGCGTCCCCAATGTGCACTCGACCGT
CCTCAGTGTGTGAGCCGTCGGAAACCTATGTCTTCTTAGCTTCTTTCTTCGTTTCGTGAACTAGATCACCATACATAACT
CTTGTCACGGGAGTGGCGCAATGGCCGACTCGGTAATCACCCCGATTTCTTGGCGTGCTGCTCCGCCTCGTCGGCCACCC
GCGGCTGCGCCACATCCGGATCCGGCTGCAGCTCCGCCAACAGAGCGCGCAGGCTGTCCAGTTCGTGGCGCAGGTAG
TCGCGCGTGGGGACCTCGCCGATGGCCAGCCGCAGCGCTGCCAGCTCGCGGGCGTTGTACTCGGTGTCGGCCTTGGTCTG
TGCGGCCCGCCGACGATCCTCTTCGAACACCGCGGTCACGCTTTTCCTGACGGTTCTGGGCGAGCAGAATCAGCGGTG
CGGCGTACGAGGCCTGCGTGGAGAAGGCCAGATTGAGCAGGATGAAGGGGTACGGATCCCAGCGCAAGCCGACCGCAAAC
AGGTTCAGCACGATCCATGTCAGTACGAGCAGCGTCTGCACCAGCAGGTAACGGCCGGTTCCGAAAAACCGTGCGATGGA
TTCGGTTGTCCTGCCGACGGCCTCGGGATCCAGCCGCGGGGCGAGCGTGCGCGATGTGCGTGGGGTGTACAGACGGCGCG
GCGCGAAGGGTTTGCTCACCGTGGTCCTCCGGGTCTGTCCGGTGCTCCGGAGGGGTCGAGCTCCGGCATATCTACACGCC
AGTCATGCGGCAATAGATGGTCGAGCAGGTCGTCCACGGTCACCGCTCCCAGCAGGTGGTTCTCGTCGTCAACCACCGGT
CCGCACACCAGGTTGTAGGCGGCGAAGTAGCGAGTCACCGCGGCCAGCGGGTCTCCGGAGTGAGCGTGAGCAGGTCAGT
GTCCACAACTCCGCCGACCAGCTCGGCCGGCGGGTCACGAAGCAGCCGCTGCAAATGCACACAACCCAGGTAGTGCCCAG
TGGGCGTGGCCGTGGGCGGGCGCGCGACGAACACCATTGACGCCAGGGCGGGGGTGAGATCGGGATCGCGGACCCGCGCC
AACGCCTCCGCAATCGAGGTGTCCGGGGTCAACACCACCGGATCGGAAGTCATCAATCCGCCCGCCGTGTCGGGGGAGTG
CGTCAGCAGCCTTCGCACCTGCCCGAGTCGCCCGGGATCCATTCGTGTCAGCAGCAACTCGGCTTCGTCGGATTCAGGA
CCGCGAGCAGATCGGCGGCGTCGTCGGGATCCATCTCCTCCAGCACGTCGGCCGCGCGTTCGGTGCCCAGTTGCGACAAC
ACCTCGGCCTGATCCAGTTCGGGCAGCTCCTGCAGGACGTCGGCCAAGCGCTTGTCGTGGAGCGCCTTGAACACCTCGTG
GCGGCGCTTCGGCGGCAGCCCGCGGATGGCGTCGGCCACGTCGACCGCTTTCCATCCCTCGAACTGGTCGAGCAGCTGTG
CCACGTCTTGACCCGGCATCGCCAAGGCCGACGGCGTCAACCCCGCCACGTTGTGCCAGTCCACGACGTGCACTGGGCAG
CGCCGTCGGAGCCGACGTTGGGTGCCGGACGGCGACCCTAGTCACCATCCAGTCGCGACTTCGGGTTTGCTCGACACCCAG
GTCGGTGACCACGACGTCGACGCGGCCAGCTCGGGTAGTGCGGGATCGTTGACCTTCACCAGGGTGTCGAGCACTTGAC
CCAGCGCCAGAGCCTCGCCTGGCCGCTGCTCGAAGCGGTGCAGTGACACGTTGCCGGTGCTCAGTGTCACCGCGTGCGGC
TCGATCGCGGCGACCCGCAGAATCGGTATGAATATCTTGCGGCGGGTCGCCAAATCGACCACCAGCCCGAGCACTCGCGG
TTGTTGGCGGACAATGCTGATGCTGATCACGACATCGCGAACGCGCCCGAAGGATTCGCCGAGCGGTCCCAGCACCGACA
TCCGCGAGAGCCGCGCCAGGTACACCCTGTTGACCGATCCCATGATTGAGAGCCTAGGCAGCTGCCTTCCGGATCAACCG
AGGGTGGGCCAATGTCGCCTAATGCTAAGGGATAGCGAAGATCCCCGCGATCATGTAGACCAGCAGGGTCGCGATGCCAA
TCACAATGCCGGCCACCGCCAGGCCGTAGCCTTCTTCGCGTGTCTGCTTGATCTGGTTGATGGCGATCGCGCCGAACACG
ATGCCCACGATCGAGCCGATGCAGCAAAGCACACCGACGAGCGCCGAGATCAGTGAGACGAGCGCCATGGTGTTCATGCC
GGGCTGCGATGGGCCGTAGCCGTCTAGGTAGCCCGGCTCCGGGTAGTAGCCGCCCGGAGATCCACCGTATGGCGGAGGCA
TGGGCGGGTATGGTATGTCGCCGTAGCCTGCTGAAGAAGTGCCGGGGGGTGGATATCCGGCGGCGCATAGCCCCCGGGT
GGCATCGGCGGTGGATAGCCGGTCGGATACCCGGGCTGGTAAGCAGGCGGGTAACCGGACGGCGGATACGCCGGGGCGG
GTGGTTGGCCATCGGCGAAGATGCCGGCGGCGCCCAAGGAGCCGTCAGCAATGGGCTGTTCGGGGGCCGCTCACCGACCG
GAGGCGGTCCACCCGCGGCGTCGTGCGCACTCTCGCCAGAGGAGCCGCTGGGAGCCGTCATGGTGATCAACCTATCCCGG
CAACGATGCTCGCCGTTCGGTGGGCCTCGGTCGCTCGCGGGTTGAGTGGATAGTGTGCCGGGAGTAGCTGGACCTGACTG
GACATGAAACGATGGCGCTGAAAAAGGGGGGCGGAGGAGAATGAGAACCGATGACTAGCCCATTCCAGCCCAGACAGGTT
CCCGGTTCAACACCCGCCGCCGCAGGTGCGGGTCGACGTGGTGTGCCCGCATTGCCCACCCCGCCGAAAGGTTGGCCAGT
```

FIGURE 5(continued)

```
CGGGTCGTATCCCACCTATGCCGAGGCGCAACGTGCGGTCGACTATCTATCCGAACAGCAGTTCCCGGTCCAGCAGGTGA
CCATCGTTGGCGTGGACCTCATGCAGGTTGAACGGGTCACAGGCCGGCTGACCTGGCCCAAAGTGCTTGGTGGCGGCGTG
CTGAGTGGCGCCTGGCTGGGCCTGTTCATCGGGTTGGTGCTCGGGTTCTTCAGTCCCAATCCATGGTCCGCGCTGGTTAC
CGGCCTGGTGGCCGGGGTGTTCTTCGGGCTGATCACCTCTGCAGTGCCGTACGCAATGGCTCGCGGCACAAGGGATTTCA
GCTCGACCATGCAACTGGTTGCCGGTCGCTACGACGTACTTTGTGATCCGCAAAATGCGGAAAAGGCACGGGATCTGCTG
GCGCGTCTGGCGATCTGAAGCCCGGACGAGAGGCAAATGTGGTCATGAGTCGCGGGCGGATACCGAGGCTGGGCGCTGCC
GTACTGGTGGCGTTGACGACCGCGGCGGCGGCGTGCGGGGCCGATAGCCAGGGGCTGGTGGTCAGCTTCTACACACCGGC
CACCGACGGCGCGACGTTCACCGCAATTGCCCAACGCTGCAACCAACAGTTCGGCGGCCGGTTCACCATTGCGCAGGTCA
GCTTGCCCAGGTCCCCCAATGAGCAACGGTTACAGCTGGCCCGACGGTTGACCGGTAACGACCGCACCCTGGACGTCATG
GCGCTGGATGTGGTGTGGACGGCGGAGTTCGCCGAAGCGGGGGTGGGCGCTGCCGCTGTCGGACGACCCAGCGGGGCTGGC
CGAGAACGACGCCGTCGCCGATACCCTGCCAGGCCCGCTTGCGACGGCCGGCTGGAACCACAAGCTGTACGCGGCACCCG
TCACCACTAATACTCAATTGCTTTGGTACCGACCAGATTTGGTAAATAGCCCGCCAACGGATTGGAATGCCATGATCGCT
GAGGCGGCCCCGGCTGCACGCGGCGGGCGAGCCTAGCTGGATCGCGGTACAGGCCAATCAGGGCGAGGGCTTAGTGGTGTG
GTTCAACACGCTGCTGGTGAGCGCTGGTGGATCGGTGCTCTCCGAGGACGGCCGGCACGTCACCTTGACCGATACTCCCG
CACACCGAGCGGCTACGGTCAGCGCGCTACAGATCCTCAAATCGGTGGCTACCACGCCCGGCGCCGACCCCTCGATCACC
CGCACCGAAGAGGGCAGCGCGCGGTTGGCCTTCGAACAGGGCAAGGCCGCGCTCGAGGTCAATTGGCCGTTCGTGTTTGC
GTCATGCTCGAGAACGCGGTGAAGGGTGGTGTGCCCTTCTTACCGCTTAACCGGATTCCGCAGTTGGCCGGCAGCATCA
ACGACATCGGGACGTTCACGCCCAGCGACGAGCAGTTCCGCATCGCGTATGACGCCAGCCAGCAGGTGTTCGGTTTCGCG
CCCTATCCGGCTGTAGCGCCCGGCCAGCCAGCCAAGGTGACGATCGGCGGGTTGAACCTGGCGGTGGCCAAGACGACCCG
CCATCGAGCGGAGGCATTCGAAGCGGTGCGTTGTCTGCGTGACCAGCACAATCAGAGGTACGTCTCGCTCGAGGGGGGTC
TGCCCGCGGTGCGGGCGTCGCTGTACTCCGATCCGCAATTCCAGGCGAAGTATCCGATGCACGCCATTATTCGGCAGCAA
CTCACCGATGCCGCGGTGCGGCCGGCGACGCCGGTGACCAGGCGTTGTCCATCCGGCTCGCGGCGGTGCTGAGCCCGAT
CACCGAGATCGACCCGGAGTCCACGGCCGACGAACTTGCGCGCAGGCGCAGAAAGCCATCGACGGCATGGGCCTGCTCC
CGTGACCTCCGTTGAACAGCGGACCGCCACCGCGGTCTTTTCCCGTACCGGGAGCCGCATGGCCGAACGGCGACTGGCGT
TCATGCTGGTCGCACCCGCCGCGATGTTGATGGTGGCGGTGACGGCCTATCCCATCGGTTACGCGCTGTGGCTTAGCCTG
CAGCGCAACAACCTGGCCACCCCGAACGACACCGCGTTCATCGGGCTGGGCAACTATCACACGATCCTGATCGACCGGTA
TTGGTGGACGGCGCTGGCGGTGACGCTGGCGATCACGGCGGTTTCGGTGACGATCGAATTCGTCTTGGGGTTAGCGCTCG
CCCTGGTAATGCACCGCACGCTGATCGGCAAGGGGTTGGTGCGCACCGCGGTGCTCATTCCGTACGGCATCGTCACGGTG
GTCGCCTCGTATAGCTGGTACTACGCCTGGACGCCGGGCACCGGGTATCTGGCCAACCTGCTGCCGTATGACAGTGCGCC
ACTGACGCAACAGATCCCGTCGTTGGGCATCGTGGTGATCGCCGAGGTCTGGAAGACGACGCCGTTTATGTCGCTGCTGC
TTTTGGCCGGGTTGGCGCTGGTCCCCGAGGATCTGCTAAGAGCAGCGCAGGTTGACGGCGCCAGCGCCTGGCGGCGGTTG
ACGAAGGTCATCTTGCCGATGATCAAGCCGGCGATCGTGGTTGCTCTGCTCTTCAGGACCCTGGACGCTTTCCGGATTTT
CGACAACATCTATGTGCTGACCGGCGGCAGCAACAACACCGGATCGGTGTCGATCTTGGGCTACGACAACCTGTTCAAGG
GGTTCAACGTGGGCCTTGGTTCGGCGATCAGCGTGCTGATCTTTGGCTGCGTGGCCGTCATTGCGTTCATTTTCATCAAG
TTGTTCGGCGCCGCGGCGCCCGGGGGTGAGCCAAGTGGCGCGTTGAACGGGTGGGCGCGCGGCCGCCCACGTATTGGGCCG
TCCTGGACACTTTGGTCGTGGGGTACGCGTTGCTCCCGGTGCTGTGGATTTTCAGCCTGTCACTCAAGCCGACGTCAACG
GTCAAGGACGGCAAGCTGATTCCGTCGACGGTGACTTTCGACAACTATCGTGGCATCTTCCGGGGCGACTTGTTCAGCTC
AGCGCTGATCAACTCCATCGGAATCGGCCTGATCACCACCGTGATCGCGGTGGTGCTCGGCGCGATGGCGGCCTACGCGG
TTGCCCGGCTGGAATTTCCGGGCAAGCGGCTGCTAATCGGGGCTGCCTTGCTGATCACGATGTTCCCGTCGATCTCTTTG
GTCACACCATTGTTCAACATCGAACGTGCCATCGGCCTGTTCGACACCTGGCCGGGGTTGATCTTGCCGTACATCACCTT
CGCGTTGCCGCTCGCGATCTACACCCTGTCGGCGTTCTTCCGGGAGATCCCTTGGGATCTGGAAAAGGCGGCCAAGATGG
ACGGTGCAACGCCCGGTCAGGCTTTCCGGAAGGTGATCGTACCGCTGGCGGCGCCGGGCTTGGTGACCGCTGCAATCCTG
GTGTTCATTTTCGCCTGGAACGATCTGCTGCTCGCGTTGTCGCTGACCGCTACCAAGGCGGCGATTACCGCGCCGGTGGC
CATCGCCAACTTCACCGGCAGTTCGCAATTCGAGGAGCCGACCGGCTCGATCGCGGCCGGCGCGATCGTGATTACGATCC
CGATCATCGTCTTTGTTTTAATCTTCCAACGACGGATTGTCGCCGGGTTGACCTCTGGCGCTGTGAAGGGATAGCGCGAT
GGCCGAGATTGTGTTGGACCACGTCAACAAGAGTTACCCCGACGGTCACACAGCGGTGCGCGACCTCAACCTCACCATCG
CCGACGGCGAATTTCTGATCCTGGTAGGGCCTTCCGGTTGTGGCAAGACCACGACGCTGAATATGATTGCTGGGCTTGAA
GATATCTCGTCGGGAGAACTGCGCATCGCCGGTGAGCGGGTAAACGAGAAGGCGCCAAAGGACCGTGACATCGCGATGGT
GTTCCAGTCGTACGCGCTTTACCCGCATATGACGGTGCGCCAGAACATCGCGTTCCCGCTGACCCTGGCGAAGATGAGAA
AGGCCGACATCGCGCAGAAGGTCTCCGAGACTGCAAAAATCCTTGACCTGACCAACCTTCTGGATCGCAAGCCCTCACAA
TTGTCGGGTGGTCAGCGACAGCGGGTCGCGATGGGCAGGGCAATCGTGCGCCATCCCAAAGCATTCCTGATGGACGAGCC
GCTGTCGAACTTGGACGCGAAGTTGCGGGTCCAGATGCGCGGCGAGATTGCCCAGCTGCAGCGGAGGCTGGGTACCACCA
CCGTCTACGTCACCCACGACCAGACCGAGGCAATGACGCTGGGCGATCGCGTGGTAGTGATGTACGGGGCATCGCACAG
CAGATCGGCACCCCTGAGGAGCTTTACGAACGGCCCGCCAATCTGTTTGTCGCGGGCTTTATCGGCTCGCCGGCCATGAA
TTTCTTCCCTGCCAGGCTGACCGCGATCGGACTGACCCTGCCGTTCGGTGAGGTGACGCTGGCCCCCGAAGTCCAGGGGG
TGATCGCAGCGCACCCGAAACCGGAAAACGTCATCGTAGGCGTGCGGCCGGAGCATATCCAGGACGCAGCATTGATCGAC
```

FIGURE 5(continued)

```
GCGTATCAACGCATCAGGGCGCTGACCTTCCAGGTGAAGGTCAACTTGGTCGAGTCTTTAGGCGCCGACAAATATCTGTA
TTTCACTACCGAGAGCCCGGCTGTGCACTCGGTTCAGTTGGACGAGTTGGCGGAGGTAGAGGGGGAGTCGGCGTTACACG
AAAATCAGTTCGTGGCAAGGGTTCCCGCCGAGTCCAAGGTAGCCATCGGGCAGTCGGTCGAGTTGGCTTTCGATACCGCC
AGACTTGCCGTCTTCGACGCCGACTCCGGTGCGAACCTGACCATTCCGCACCGCGCCTAATGGCGGCGAGCGGACACATA
AGCCCCCGCCACGCCGAAGGATTTGGAGCTTTTTGCGTCTGTTCGCCGACGCGAAGCTAGAGCCAGTTTCTGTTGCGGAA
GACGTGGTAGAGGAACAGACAGATAAGGACCATCCCGCCGATCACTGTCGGGTAACCCCACCTGGAGTCCAGCTCGGGCA
TGAAGTGAAAGTTCATGCCATAGATGCCCGCGATCATGGTGGGGACCGCGATGATACCTGCCCACGCGGATATCTTGCGC
ATGTCCATGTTTTGCTGCATGCCGACCCGGGCGAGCGCGGCCTGCACCAGCGAGTTGAGCATGTCGTCGTAGCTGGCGAT
CTGGTCGGCGGCCTCGGTCTGGTGGTCGGCGACGTCGCGCAGGTAGCGCCGCACTTCTTTCGAAATGAGGTCTTTGCTCT
CGGTCTGCATGCGCTGGAATGCGGTCGATAGCGGATTCACGCACCGGCGCAACTCGACCACTTCCCGCTTGAGCAGATAG
ATCGGTTCGATGTCGAGCTTGCGGCCCGGCGCGAACGCTACTTCCTCGATGCTGTCGATATCGGTCTCCATGAGATTGGT
CACCTCGAGGTAGTGGTCGACCACGTAGTCGGCGATCGCGTGCATCACCGCATACGGTCCCAACCGCAAATGTTCGGGGT
CGGCATCCATCCGCTTACGCACCTCGGATAACCCGCCGTGTTCGCCGTGGCGGACGGTGACCACGAAATCCTTGCCGACG
AAGATCATGATCTCGCCGGTTTTGACGATCTCGCGGGCCAGTACCACCGATTCGTGCGGGACGTAGTTGACGGTCTTGAG
GACGAGGAACAGCGTCTCGTCGTAGCGCTCCAACTTGGGTCGCTGGTGCGCGTGCACGGCGTCCTCAACGGCTAACGGGT
GCAACCCGAAAACGTCTGCTACGTCCTGCATCTGGTTTTCATCGGGCTCGTGCAGCCCGATCCAGACGAACGCCTCCTGC
CCGGTCAGTTCGATCTCGCGCACCTCGCGCAGCGCGGCGGCGTAGGTGTACTTGCCGGGCAGTCGCTGGCCGCAGACGTA
GACACCGCAGTCGACCAAGGCTTGGGCCGGTGGCTGGGCAACGGGGTGTGCGTTCGGCGGCTGGGGTCGCGCGACCGGTC
GCAGCACTTCGGGCAATGCGTCAAACCCTGGGAACACGTCAACCTCCGATCGCGGTGGATCTGATCGGGCGGTGCTCCAG
GTTACGCGTCCCGGTATGGAACTTGGTAAACGTCAGTCGTAGCTGTGGGGGTTGGACCCCAGATGTCCGTCCGGTGCCGG
TGCGCTAGTTTCAACCCGAAGCCAAGTCCGTAAGGAGCAGAACCGACGTGAGCGCTAGTCCTCTCAAGGTCGCCGTTACC
GGCGCCGCCGGCCAAATCGGCTACAGCCTGTTGTTCCGCCTGGCCAGCGGCTCTTTGCTGGGCCCTGACCGTCCGATCGA
GCTGCGGCTGCTCGAGATCGAGCCGGCACTGCAGGCGCTCGAGGGTGTGGTGATGGAACTCGACGACTGCGCTTTCCCGC
TGTTGTCCGGGGTGGAGATCGGTTCCGATCCCCAGAAGATCTTCGATGGTGTGAGCCTGGCCCTGCTGGTCGGAGCCCGC
CCCCGGGGCGCGGGCATGGAGCGAAGTGACCTGCTGGAGGCCAACGGCGCGATCTTCACCGCTCAGGGCAAAGCCCTCAA
CGCTGTCGCCGCGGATGACGTTCGCGTCGGGGTGACCGGCAACCCCGCCAACACCAACGCGCTGATCGCGATGACCAATG
CGCCCGACATTCCCCGCGAGCGGTTCTCGGCGCTCACCCGGCTGGACCACAATCGGGCGATCTCGCAGCTGGCCGCCAAG
ACCGGCGCGGCGGTCACCGACATCAAGAAGATGACGATCTGGGCGCAATCACTCGGCCACCCAGTACCCCGACCTGTTCCA
CGCGGAGGTCGCCGGAAAGAACGCGGCCGAAGTGGTCAACGACCAGGCCTGGATCGAGGATGAATTCATCCCGACGGTCG
CCAAGCGCGGTGCGGCGATCATCGATGCGCGCGGCGCGTCGTCGGCCGCCTCGGCCGCGTCGGCAACCATCGACGCTGCC
CGGGACTGGTTGCTGGGGACGCCGGCGGACGATTGGGTCTCGATGGCCGTCGTCTCCGACGGGTCCTACGGGGTGCCGGA
GGGCTTGATCTCCTCGTTTCCGGTCACCACCAAGGGCGGCAACTGGACGATCGTGAGCGGCTTGGAGATCGACGAGTTCT
CCCGCGGCCGGATCGACAAGTCAACCGCCGAGTTGGCTGACGAGCGCAGCGCGGTCACCGAGCTCGGCCTTGATCTGAGCG
CAGGTCAGCCGCGCACTGAGCGGAGCCCGAGTCATCTTGACGTGTGTTTGTCCAGGCATCATGATGACCTGTATGCGCAC
CACCTTGACGCTCGATGACGACGTCGTCCGGCTGGTCGAAGACGCAGTGCATCGCGAACGCCGCCCGATGAAGCAGGTCA
TCAACGATGCGCTGCGCAGAGCGCTGGCGCCGCCGGTGAAACGGCAGGAGCAGTATCGGTTGGAGCCGCATGAGTCGGCT
GTGCGTTCCGGGTTGGATCTGGCCGGCTTCAACAAGTTGGCCGACGAACTGGAGGATGAGGCGCTGCTGGATGCCACGCG
TCGGGCCCGGTGATCATCCCTGACATCAATCTGCTGCTCTACGCGGTCATCACCGGATTCCCGCAGCACCGGCGCGCGCA
TGCGTGGTGGCAAGACACCGTCAACGGCCACACCCGTATCGGGCTGACGTATCCGGCGTTGTTCGGGTTCCTACGGATCG
CCACCAGTGCCCGCGTGCTCGCCGCCCACTGCCAACCGCGGATGCGATCGCCTATGTGCGCGAGTGGCTTTCGCAGCCG
AACGTGGACCTACTCACGGCGGGTCCGCGCCACCTGGACATCGCGTTGGGCCTGCTCGACAAGTCGGCACAGCCAGCCA
CCTAACCACCGATGTGCAACTGGCCGCCTACGGCATCGAATACGACGCCGAGATCCATTCCAGTGACACCGACTTTGCCC
GATTCGCCGATCTGAAGTGGACCGACCCGTTGCGCGAATAATGACTGCCGCTCTGCCCTCGGGTCAGCCGTTCAGGCCGT
GCTGACCGTTGGCGCCGGTAGCGCCTTGAGTACCGGGATCGCCGGGGCGCCGGGGTTGAACCCGGTCCCGCCGCCGCCG
CCCGCGCCGCCGTTGCCGCCCGCGCCGCCGAGGCCCCGGCCGCGCCGGAGCCGGGGCTGCCCGACTGTCCGAACAGTCC
GCCCGCACCGCCGGTCCCGCCGTTTCCGCCGACGCCACCGGCCCGCCGGCCCCGCCGTCGCCGCCGGCCGTTGCCGCCGTCAC
CGCCGTCGCCGTCCTGGTTGGCCATGCCGTCGGCGCCGATCCCGCCGTTGCCGCCGTTGCCGCCGCTGCCGCCTTGAGCG
CCGATGCCCCGTCGCCCCCGACGCCGCCGTCGCCGCCGGCGCCGCCCGTGCCGAGCAGTAGCCCGCCGCGACCCCCGCT
GCCCCCAAAGCCGCCGGCGCCACCAACGTCAGCCGAGGCACCGACGCCGCCGTCGCCGCCGGCACCACCATTGCCCCCGG
TGGAGTTGCCCCCAGGAGGATTATCTTGATTGGCATTTCCTCCGGCGCCGCCGGCACCACCGGGAGCGCCGATACCGCCG
TTCCCGCCGGCGCCACCGTTGCCCCCTATGCTGTTGCCAGCATTTGCAACATTGGCGCTGCCACCCGCTCCGCCCAGCCC
CCCGCCGCCGCCGGCTCCGCCGTTTCCGCCGGCGCCGCCATTGCCGCCGACAGCGTCAEeAAAGCCGCTTTGAGCGGCGC
CACCGTTACCGCCGCAACCTCCGGAGGCGAAGTTGGCGCCGTCGCCGCCGTCGCCGCCGGCACCCCCGGACAGTCGGTC
TGCCCAAGGTTGGTTCCATCCCCGCCTATGCCGCCTGCACCACCGCCCACGCCGGGGTTGACTGCGTTGCTGCCCGAGCC
GGCGTCGGTCCCGTTGCCATCGGGTCCGGTAGTGCCGTCGGCGCCATCGGTCGCGTGCGTGACCTGATGGGACACCGGGT
TTTGCCCGTTGGCGCCGGCCGCTCCTGCCGCTCCGGCTCCACCCGCCCCCCGTTGCCCCATAGCCCGGCGTTGCCGCCG
```

FIGURE 5(continued)

```
TGGCCTCCGTTGCCGCCATTGCCCCCGATCTGGGTGGCCGCCCCACCGTTGCCGCCGAGCCCACCGTTGCCGTATAGCCA
CCCGCCGTTGCCGCCGGCACCGCCGTTCGCGCCGGGCCCGCCGGCTCCCCCGGCGCCACCGTTGCCGATCAACCCGGCCG
CGCCGCCGCGACCGCCGGGCTGGCCTGGGGTGCTACTCGAGCCGCCGTTGCCGCCGTTGCCGTACAACAAGCCACCGTCG
CCCCCGTTTTGTCCCGGCCCGCCGTTGGCGCCATCGCCGATCAGCGGGCGCCCCAGCAACAGCTGGGTGGGCCCATTGAC
CACATCCAGCACCGCTTGCATCGGGGAGGCATTGGCGGCCTCGGCCGCCGCATACGAGCCGGCCGCCGAACTCAGTGCCC
GCACAAACTGCTGATGAAATGCCGCCGCCTGTGCGCTCAGCGCTTGATAGGCCTGGGCGTTCCCGGAAAACAGCGACGCG
ATGGCCGCTGATACCTCGTCGGCACCCGCGGCCAGCAGCCCCGTGGTCGGGGCCTCGGCCGCCCTGTTAGCTGCGGCCAG
CGCCGAGCCGATGCCCTCCAAATCAGCGGCCGCGGCCACCAACACGTCCTGCGCTGCAATCAGATACTCCATCGCGGGGC
CTCTCTCGCGGCGAGATTGACCAACGGGTCGGCACGAAGCGTGTCCCGTTGCTTGACGGTGCATTGCGTGTTTGCCTGGA
TCCCCGCGCCGACGGTGTGGATCGGGCCCAGTACCCTCAAGCCCGTGCCAACTGCATCTGTCGCGGTGACTATCGGCTCA
GACACTTCGGTGTGAGAATCACCAGGATCCTCGCGCTGCTGCTTGCCGTCCTGCTTGCAGTGTCTGGCGTGGCTGGCTGC
TCGGCCGACACCGGCGATCGCCACCCGGAGTTGGTGGTCGGATCCACGCCGGACTCCGAGGCGATGCTGCTGGCCGCCAT
CTACGTCGCGGCGCTGCGGTCGTACGGTTTTGCGGCGCACGCCGAAACCGCCGCCGACCCGGTGGCGAAACTGGACTCGG
GCGCGTTCACCGTCGTACCCGCTTTCACCGGTCAGATGTTGCAGACCTTGCAACCCGATGCGTCGGTGCGCTCGGATGCC
CAGGTATACCGCGCCATCGTCTCGGCCCTTCCCGAGGGCATAGCCGCAGGCGGACTACACCACCGCCGCAGAAGACAAACC
CGCGTTGGTGGTGACTCAATCCACCGCCAAGGCCTGGGCGGCGGCGATCTCAGCGAGCTGCCCAGCCACTGCCGCGGGT
TGTTGGTCGGGCGCGTTGCCGGCGCCCACACACCCGCGGCCGTGGGACCGTGCCGGCTGCCCGCCCCGCGTGAGTTTCGG
AATGACGCAACAATGTTCGCCGCGCTGCGGGCCGGACAGCTGGTCGCGGCCTGGACCACCACCGCCGACCCCGACATCCC
CCCCGGACCTGATCATGCTGACCGACGGCAAGCCCGCGCTGATCCGGGCCGAGAACATCGTTCCGCTGTATCGTCGCAACG
CGCTGACCGAGCGGCAACTGCTGGCCGTCAACGAGGTCGCCGGCGTGCTGGACACCACGGCCCTGATCGGGATGCGCCGC
CAGGTGGCCGCGGGGGCCGACCCGGCCGGTGCGCCGCGGCTGGCTCGCCGAACACCCGCTGGGACGTTGAGCCGCCAC
GAGCGTCCGGGTCGACGCGATGACACACCGCGTCGGCCGGCGAACAACCTTCGGGCGCGCTTTCCTCACCAGCCGTCAGCGCG
GGCGGGTATCAACCGGCCGGTGATGATCGGAAAGATCCGCTGATATCCGGAACCGGTCAGCCGGACCACCAGGTCCAGT
ACCTTGGCGTCGACACCCACCAACACCCGGGCCTTGTTCTTGGCCACCCCCGTCAGGATGATCTGCGCGGCCCGCTGTGG
GCTGAGATGGGCCACCCGCTTATCGAACGTCTCGGCCAGCTCGGCCTGGTCAAGTCCCTCGGCGGCGGTGGCGTTACGGG
CGATCGCGGTCTTGACACCGCCGGGGTGCACCGTCGTCACCTTCACCGGGTGACCCGCCAACGCCATTTCCTGGCGCAGC
GCCTCGGTAAAGCCGCGGACGGCGAACTTGGCCGAGTTGTAGGCCGCCTGACCCGGCGCCGAAAACAACCCGAACACGCT
GGAGATGTTGATGACGTGGCCGTCCCCGGAGGCGATCAAATGCGGCAGGAACGCCTTGGTGCCGTTGACCACACCCCAAA
AATCGACGTCCATCACCCGTTCGATGTCCTTGAACTGGCTGACCTCGATATCGCCGGTAAAGGCGATGCCGGCGTTGTTG
TAGATCTGGTTCACAGTGCCGAAGTGCTCGTTGACCGCATCGGCGTAGGCTAGGAAGGCTTCGCGTTCGGTTACGTCGAG
TCGGTCCGTCTTGACCGGCGTGCTGATCGCCTTTAGCCGGTGCTCGGTGTCTGCCAGGCCGTCGGTGTCGACGTCGCTGA
TGGCCACCTTGGCGCCCGAGCGGGCCAGCTCGATTGCCAGCGCCTGCCCGATGCCCGATCCCGCGCCGGTGACAACGGCG
ACCTTTCCGGCGAACCCCTCCATGACGTACCCCTCCCTTGTCTCGGCTGCCATCAGGTTAGCCGGTACCCGGGGTACGGCT
TAACGTGGCCGGCACGGGTTCATTCGGTAGCTGGCACTGCGACGAGCGATGTGGATGATCTCGACTCGGTGGTGGCCGTC
GTCGATGGCGTAGACGACGCGGTAATCACCGCGGCGGGCTGAGTGGAGGCCTTCAAGGTCATTGCGCAGCGGCTTGCCCA
ACCTATGCGGGTTGTTAAGCAGCGGTCCGAAAACAAACTCGACACATGCGGCGGCGATCTTTTCGGGTAAGCGTTGCAGG
TCGCGTGCCGCTGTCGCGGTGATCGCCACGTGGTAGGGATGGTCGTCGCTCACCGCGCGGTGTAACGGTTGCGGATCTCG
TCGTTGCTCACGAAGCGCCCTGCGGCAACATCGGCGAGGCCTTCACGAATGGCCTCGCTGGCGCCAGGGGTGCGTAGCAC
CTCCAGCGTTTCCTCGATGGACGCCAGGTCATCGGCCGAGATCAATACCGCCGCCGGATGACCGTGCCGGGTTATCGTGA
TGCGCTCGTGTGTCAGCTCGACTTCGGCGACGTACTCAGAGAGGCGATTGCGGACTTCGCCCAGTGGGACAACAGCCATA
ACCGCGATTGTAGCTAAAAGTATGGCTAAACCTGTACGCCGAGCATCGGCTTACCGAGCCGAACGCCTCGTCGCTGTTT
GATGTCTCCTCGAGCGTTCGGCTGAGCGAACTCAGCCGAACGCCTCGTCGAGGATCTCCTGCTGTTCGACGGCGTGCACC
TTCGACGAGCCTGACGACGGGCTGACATCGCCCGGCGCGAGATTCGCTTGATCCCGGCCAACTTGTCAGGCAGCAGCTC
GGGTAGTTCGAGCCCGAATCGCGGCCACGCACCCTGGTTGGCCGGTTCCTCTTGGACCCAGAAGAACTCCTTGACGTTCT
CGTAGCGGTCCAGCGTTTCACGCAGTCGACGCCTGGGCAGCGGGGCGAGCTGTTCAAGCCGCACGATCGCGAGGTCATTG
CGGTTGTCCTTGGCCTTGCGGGCGGCCAGCTCGTAATACAGCTTGCCACTGGTCAGCAGGATCCGGCTGACCTTGTTGCG
GTCTCCGATGCCGTCCTCAACTTCGGCGACGTACTCAGCGGAACTTGATCTCGGTGAAGTCCTTGATTTCGCTGA
CGGCGGCCTTGTGACGCAACATCGACTTGGGCGTGAACACGATCAGCGGGCGTTGGATGCCGTCCAGGGCATGCCGGCGT
AGCAGGTGGAAGTAGTTCGACGGAGTCGACGGCATCGCGATGGTCATCGAACCTTCCGCCCACAACTGCAAGAAGCGTTC
GATCCGGGCAGAAGTGTGGTCGGGTCCCTGCCCCTCGTGCCCGTGCGGTAACAGCAGCACGACGTTGGACAATTGGCCCC
ACTTGGCCCTCACCGGAGCTGATGAACTCGTCGATGATCGACTGCGCGCCGTTGACGAAGTCGCCGAACTGCGCCTCCCAG
AGCACCACGGCGTCCGGATTGCCCACAGTGTAGCCGTACTCGAAGCCGACGGCGGCGTAGTCCGACAGTGGCGAGTCGTA
GACCAGGAACTTTCCGCCGGTCGGGCTGCCGTCGGAGTTGGTCGCCAGCAGCTGCAGTGGTGTGAACTCCTCGCCAGTGT
GGCGGTCGATGAGAACCGAATGCCGCTGGGAGAAGGTGCCGCGGCGGCTGTCCTGCCCCGACAAGCGCACCAGCTTGCCT
TCGGCCACCAGCGAGCCCAGCGCCAGCAGCTCGCCAAAGGCCCAGTCGATCTTGCCTTCATAGGCCATCTCCCGGCGCTT
CTCCAGCACCGGTTGGACTCGCGGGTGCGCGGTGAAGCCGTTCGGCAAGGCGAGGAACGCATCGCCGATCCGGGCCAGCA
```

FIGURE 5(continued)

```
GCGACTTGTCCACCGCAGTGGCCAGCCCCGCGGGAATCATCTGGTCGGACTCGACCGACTCGCTCGGCTGCACACCGTGC
TTCTCCAGCTCGCGCACTTCGTTGAACACCCGTTCGGCTGGCCCTGGTAGTCGCGCAGCGCGTCCTCGGCCTCCTTCAT
CGAGATGTCGCCACGTCCGATCAGGGCTTCGGTGTAGCTTTTGCGGGCCCCGCGCTTGGTGTCGACGACGTCGTACACGT
AGGGGTTGGTCATCGACGGGTCGTCACCCTCGTTGTGCCCGCGGCGGCGGTAGCACAGCATGTCGATGACGACGTCCTTC
TTGAACCGTTGTCGGAAGTCCACCGCCAACCGCGCCACCCAGACACACGCCTCCGGGTCGTCGCCGTTGACGTGAAAGAT
CGGTGCCCCGATCATCTTTGCGACGTCGGTGCAGTACTCGCTGGACCTGGAATACTCGGGCGCGGTGGTGAAGCCGATCT
GGTTGTTGACGATGATGTGGATGGTGCCGCCGACGCGGTAGCCCGGCAGATTCGCCAGGTTCAGCGTCTCGGCGACCACA
CCCTGACCGGCGAACGCGGCATCGCCATGCAACATCAGCGGCCACCACCGAGAACGCCCGTTGGCCGTCGCTGTCGATGCT
TCCGTGGTCGAGCAGATCCTGCTTGGCCCCGCACCAATCCCTCCAGCACCGGGTCGACGGCCTCCAGATGCGACGGGTTGG
CGGTCAGCGACACCTGAATGTCGTTGTCGCCGAACATCTGCAGGTACAGCCCGGTGGCGCCCAGGTGGTACTTGACGTCA
CCGGAGCCGTGCGCCTGCGACGGATTCAGGTTGCCCTCGAACTCGGTGAAGATCTGCGAGTACGGCTTGCCGACGATGTT
GGCCAGCACGTTGAGCCGGCCCCGGTGCGGCATCCCGATGACCACCTCGTCGAGGCCGTGCTCAGCGCACTGGTCGATCG
CCGCGTCCATCATCGGGATCACGCTTTCGGCGCCTTCCAGCGAGAACCGCTTCTGGCCGACGTACTTGGTCTGTAGGAAC
GTTTCAAAGGCCTCGGCGGCGTTGAGCTTGCTGAGGATGTATTTCTGTTGGGCCACAGTGGGTTTGACGTGCTTGGTCTC
GACCCGTTGTTCGAGCCACTCCTTTTGTTCGGGGTCGAGGATATGGCGTACTCCACGCCGATGTGGCGGCAGTAGGCAT
CGCGCAGCAAGCCCAGCACGTCGCGCAGTTTCTTGTACTGCGCACCGGCAAAGCCGTCGACCTTGAACACCCGATCGAGA
TCCCACAGCGTCAGGCCGTGGGTCAGCACTTCGAGGTCGGGGTGACTGCGGAACCGAGCTTTGTCCAACCGCAGCGGGTC
GGTATCGGCCATCAGATGGCCGCGGTTGCGGTAGGCCGCGATCAAGTTCATGACGCGAGCGTTCTTGTCGACGATCGAGT
CGGGGTTGTCGGTGCTCCAGCGCACCGGCAGATATGGGATGCTCAGTTCGCGGAAGACCTCGTCCCAGAAGCCATCCGAG
AGCAGCAACTCGTGGATGGTGCGCAGGAAGTCGCCCGATTCCGCGCCCTGGATGATGCGGTGGTCGTAGGTGGAGGTCAA
AGTGATCAATTTGCCGATGCCCAGCTCGGCGATGCGTTCCTCGCTGGCGCCTTGAAACTCGGCGGGGTATTCCATGGCGC
CCACGCCGATGATGGCGCCCTGGCCGGGCATCAGCCGCGGCACCGAATGCACGGTGCCGATGGTTCCGGGATTGGTCAGC
GAAATCGTCACGCCGGCAAAGTCTTCAGTGGTCAGCTTGCCGTCGCGGGCCCGGCGTACGATGTCTTCGTAGGCCGTGAC
GAACTGCGCGAATCGCATGGTCTCGCACCGCTTGATGCCGGCCACCACCAGGGAACGCTTCCCGTCCTTGCCTTGCAGGT
CGATCGCCAGGCCGAGATTGGTGTGCGCCGGCGTGACCGCGGTGGGCTTGCCGTCGACTTCGGTGTAGTGCCGGTTCATG
TTCGGGAATTTCTTCACCGCCTGCACCAGGGCGTAGCCCAGCAAATGCGTGAACGAGATCTTGCCGCCGCGGGTCCGCTT
CAACTGGTTGTTGATGACGATCCGGTTGTCGATCAGTAGCTTGGCCGGGACCGCCCGGACGCTGGTCGCCGTCGGCACCT
CCAACGACGCGGACATGTTCTTGACGACGGCCGCGGCGGCGCCGCGCAGCACCGCTACCTCGTCACCTTCGGCTGGCGGG
GGAACGGCAGTTTTGGCGGCCAGTGCGGCGACCACGCCGTTGCCCGCGGCCGCGGTGTCGGCCGGCTTGGGGGTGCCTG
CGGGGCGGCCGCAGCGGCCCGCTCGGCAACGAGTGGCGAGGTAACCCGGGTTGGTTCGGCAGCTGGTTGGGAGGTGGGTT
CGGGGCTGTAGTCAACCAGGAACTCGTGCCAGCTGGGATCGACCGAGGAGGGGTCGTCGCGGAACTTGCGGTACATCTCT
TCGACCAGCCATTCGTTTTGCCCGAATGGTGAACTTATGTTGGCCACGGCCGCTGTTCGCCTCGATTCTTCTGCTAGTTG
AAGTCCTGCAAGCGCATTGCGCGGCGCCTGCTGGCAGTCGGTGAACGGTCTGCCCCATAAAGGCTAACGCTTTGCCAGCG
ATTCGCCAGAGAGACCGGGCAACGCGCGCTAGCTGGCATCCCGAACGGTCGGTAGCACGTGCAGGGTGACCGGCCAGCGC
GCCGGCGGGGTGCCGAATGCCGATCGCGCATTACGGACGAGCTTCTTGCCGACCAGCCGATTGCCGATGGCGCCGATGAT
CGCGCCGATACCCATCGGCACCAGCTTGCCAAACATGAGCGCGCCGCGTTTCAGCGCGAATCGTTTGACGACGTATTTGA
GCATTCGCGAGTTCAACGACGATATCGCCGGCAGCGGCAGCGAGGCCATGGTCTCCGACACCCAGCCGCCGCTGGTTCGG
CCCGGACCGAGCAGATCGGCCACCGCAGTAGTGTTGTCGCCGACCAGCACCGCCAAGACCAGGGCACGGCGCCGTTCTCG
GTGGTCGAGGGGAATGGCGTGTACCGAGGCCAGCGCCAGCAGCGCGGTGGCCTCAAGGAACACGACAACCTCTC
CGGCCGCGGCGAACCATGCGGCCAGGGTGCCGATCCCCGGTAAGGTCGCGGCCGCACCTACCGCCGCTCCACTGGCCGTC
ACCACCGACAAGAAGCGTTTCTCGAGCTTGGCTACGATCTTGGCGGGGCTGGCCCCCGGGTGGGCGCGACGCAGGCGGGC
CACATACGCCTGTGCTGCCGGGCCCTGTATCCGCGAACTCCGTTCGATGACCTGCGCCAATGCCCGCGTGGACACTTTGG
GCCGCCCGCCGGTCCCGGCCAGCTGCGGGTCCGGCTCAGCTGCATTTGCGGATCGATTGTCGAACCTTTTCCAAGACCTG
ATTCGTCGAGCGCTCATCTTCTCTCCTGCGAATGGCGTCCCCTCAGGCTAATGCCGGTTCAACGATCCGAGCATGTGTTT
CGGTAGCGGCGCGGTTCACCGCTCGAAGCGGAATAATGCGGCGTGGACATTGGTGACGATACGGGTTGCCCTGGTGCATG
CCGTGACGCCCGTGACCCAATGCCACCGGTAGCAAGCCAAACGAGGTGCGTGTATGACTACGGCGATACGCCGGGCGCC
GGGAGCAGCTACTTCCGAAAACCCCTGGCCTGCGCTGTGGGCGATGATGGTTGGCTTCTTCATGATCATGCTCGACTCCAC
CGTCGTAGCCATCGCGAATCCGACCATCATGGCCCAGCTACGCATCGGTTACGCCACCGTGGTTTGGGTGACCAGCGCCT
ATCTGCTGGCCTACGCGGTGCCAATGCTGGTGGCCGGCCGGCTTGGCGACCGGTTCGGCCCGAAGAATCTCTACCTGATT
GGCCTGGGGGTATTCACCGTTGCGTCGCTGGGGTGCGGTCTGTCGAGCGGTGCCGGCATGCTGATTGCCGCTCGAGTGGT
GCAAGGCGTCGGCGCCGGATTGCTTACCCCGCAGACGCTGTCGACGATAACGCGGATCTTCCCGGCTCATCGCCGCGGTG
TCGCGCTGGGCGCATGGGGCACCGTCGCCAGTGTCGCCAGCCTGGTGGGACCGTTGGCCGGCGGCGCCTGGTCGACAGC
ATGGGTGGGAGTGGATTTTCTTCGTCAACGTTCCCGTCGGCGTCATCGGCCTGATCCTGGCGGCCTATCTGATTCCGGC
ACTACCCACCACCCGCATCGGTTCGATTGGTTCGGCGTCGGATTGTCTGGTGCGGGAATGTTTCTGATTGTCTTCGGAC
TACAGCAGGGCCAGTCCGCCAATTGGCAGCCTTGGATTTGGGCGGTGATCGTCGGCGGTATCGGGTTTATGTCGCTGTTC
GTTTACTGGCAGGCGCGGAACGCCCGCGAGCCGCTGATCCCACTGGAGGTCTTCAACGACCGGAACTTCAGCTTGTCCAA
```

FIGURE 5(continued)

```
CCTCAGGATAGCGATCATCGCCTTCGCGGGGACGGGGATGATGCTGCCGGTGACGTTTTATGCGCAGGCGGTGTGTGGGT
TGTCGCCGACCCACACGGCCGTGCTGTTCGCGCCGACGGCGATCGTCGGTGGCGTGCTGGCCCCGTTCGTCGGCATGATC
ATTGACAGGTCCCATCCGTTGTGCGTACTGGGTTTCGGCTTCTCGGTGCTGGCGATCGCAATGACATGGCTCTTATGCGA
GATGGCTCCGGGCACGCCCATCTGGCGGCTGGTGTTGCCGTTCATCGCGTTAGGCGTTGCTGGGGCGTTCGTGTGGTCGC
CGCTGACCGTCACCGCGACCCGCAATCTACGGCCGCACCTGGCCGGTGCGAGCTCAGGTGTGTTCAACGCCGTCCGGCAG
CTGGGGGCTGTGCTGGGGAGCGCGAGCATGGCCGCGTTCATGACGTCGCGCATCGCCGCCGAGATGCCCGGTGGTGTGGA
CGCCCTTACCGGTCCCGCCGGGCAGGACGCTACCGTGTTGCAGCTGCCCGAGTTCGTGCGCGAACCCTTCGCGGCCGCGA
TGTCGCAATCGATGCTGTTGCCCGCCCTTCGTCGCCCTATTCGGGATCGTTGCCGCGTTGTTCCTGGTTGACTTCACCGGT
GCTGCGGTTGCCAAAGAGCCGTTGCCCGAATCCGATGGCGACGCTGACGACGACGACTATGTCGAGTACATCCTTCGTCG
GGAACCGGAAGAGGATTGCGACACCCAGCCGCTGCGGGCGTCGCGCCCGGCAGCGGCCGCAGCGTCACGCAGCGGTGCTG
GGGGTCCGCTGGCGGTCAGCTGGTCGACGTCAGCCCAAGGAATGCCCCCAGGTCCACCAGGCCGTCGGGCGTGGCAGGCA
GATACTGAGTCAACAGCTCCGAGCGCACTATAACCGCGGCATACTGTGCCCGACTGACCGCGACGTTGAGCCGATTCCGG
TTGAGCAGGAACGAGATTCCGCGTGGAACATCGTCGGCGGACGAGGCCGTCATCGAGATGAAGACCACCGGTGCCTGCCC
GCCCTGGAATTTGTCGACGGTGCCTACCCGTACTCCGTCAGCCCCGCCAAGTCCGGCAGACGCCAACCGCCGACGGACCA
GCGCCACCTGGGCGTTGTACGGCGCGAGCACAAGCACATCGGAAGCGGCCAGTGGCCGGGTGCCGTGCTCGTCGGTCCAC
GGCGAGCCGAGCAGCTGCCGCAGCTCGGCGAGGATCGCCTCGGCCTCTTCGGGGCTTTCGATCGAATTGCCCTTGTGGTG
CACGCCACGCGTATGCACCCCGGGGGATACCCGTCGAGGCGGCGCACGGCGGTGCGCTCGGTGTGGGAACACAGCCTGC
CCTCGTAGGACAACGCCGACACGGCCGCGCACACCGCCGGGTGCATCCGGTACGAGCGGTCTAAGAAGTAGCCGCGTTCG
TCGGGCAGCGTGTGTTGCCCATCTACCAGCCACGACAATGCGGAGGTGTCGACGGGTTCGGGATGTGTGCCCTGACTTAC
CTGAGGCAGTTGCTGTGGATCGCCAAGCAGCAACAGGTTTGTGGCCGCGGGCGCCACGGCGATGGTATTGGCCAGGCAGA
ACTGGCCAGCCTCGTCGATCACCAGCAGATCCAGGCTGGCTTTCGGCACCCGATTGCCGTTGGCGAAGTCCCACGCCGTG
CCGCCGATCACGCATCCGGCGGTGTCGGATGAATTCTGTGTACTGGCTCCCGTCGATCGACTGCCAGCGCCCAGCGGT
GTGGTCGTGCGGCTTTTTGGCGACCTGCCCCGGGTCCAGGCCAGCGCTGATCACACCTTCCAACAGGTTCTCCACCGTGG
CGTGCGACTGGGCGACAACGCCAATACGCCAGGCATGCTCGGTGACCAACTCCGCGATCACCCGGGCCGCGGTGTATGTC
TTGCCGGTCCCCGGAGGGCCGTGCACCGCCAGGTATGACGAGTCCAAGTCCAGCGCCGCCGCGGCGATATCGGTGACTGG
GTCACTGCTGCGGGGCAATGCGGCGCCGCTGCGCGTGCGAGGAGGGCGACGCAGCAGCACGTCCATTAGCGCGGTGCTGG
GCAGTTGCGGCGATCCGGAAGCCACGGCAGCGGCCGTCGATTCGATCGATTCCCGCAGGGCCGTCGTCGGCACCGGCGGC
CCGGGAGCGAGCGCGAACGGGAGCTGCTGAAATGTATTGCCGTCACTGCCGGTTCGTTCGACGATGACCACCTCGGTGGG
CACAGTGGGGTCGTCGGTCTCAACCACTGCGGCGGGGCCCGCGGCTCGCGATCAGGATTGTCGGTCATGCCCGGCGGCGG
CCGGGGGTTCGTAGAGGGCAAACACATTCCCGTTGAGGTCCCCACGTGCCAGTTCACCGGTAAGCCGGACCCGCCGCTGC
GGCTTGCGCGCGCGAGGCGGCATATGCCAGTCGACGGTGACCGAAGCCTCGCTGGCAAGGAAGACGTCCGTGCTGTCCGA
CCATTCGTCGACGGGGTAGTTGAGCCGGTCGAAGTGCGCCCACCAGAACGGCTTGTCCTCGCGGCGATGATAGCCGCGGG
CAGCGGCCAGCAAGGCGACCGCTGTCTGTTCCGGCGTGCGCTCGCCGGCGGCGGCATCGCCGGTGAACTTGGACAGTACC
GACGCCAGCGAGTCACCGTCGTCGATAGGGTCGGCGTCCGGAACTGGTTGAGCGCCAATGGGTGTGACGCCGGCTTCCCA
GGCGCGCATGAGCAGCCAGTCACGCAGCGCGCGGGTGGACCGGCAGTCGTAGTGGTTGTAGCCTTCGATCTCTTTGAGCA
CGGTTGCCGCCTCATCGATGCGGCCGGCCGCGCAGTTCGCAGTACCGGGCATAGGAGTTGATCGAGTCGGCGGCGGTG
GTGACGTCGCCGGAGCGTGGCTGCGTCCCGAGGTACAGCGGCTCCAGCGCCTTCAAGCTGAACGAGTCGGTGCCCACCCG
AATGCTCTTGCGTACCAACGGGTATAAGTCCACCAGGACTCCGTTGCGCAGCAAGTCGTCGACGTCGTCCTCGCCGATGC
CGTAGCGTCCGACCAGCCGCAGCAGCGCGGTCTTCTCGTAGGGCGCGTAGTGGTAGATGTGCATGTTGGGGTGGCGCCGG
CGCCGTCTGGCGACTATCGCCAGGAAATCGGTCAGCGCCTGGCGTTCGGCTGTCCGGTCATGCGCCCACAATGGTCGGAA
TACTCCCGCCCGTCCGGCTTCCAGCACCCCGAACAGGTATTCCAGGCCCCACTGTTTGCCGTCGGCGGTCCACAGCGGGT
CACCCTCGAAGTCGAAGAACAGGTCGCCGGGGTTTGGCTCCGGCAGCAGTGTCAGCGGCCGCGGGTCGACGATCTCGAAC
TGTGGTGCTCCCGTATCGCGTTGGCGGATTTGCAGTTTGGCCTGTGCGGTCAGCTTGCCCAGCGCGTTCGTGGTCAGGCC
GGGAACCGGCGCGGTGTGATCTGCCAGTTCGGCGATCGTGGTGATGCCGGCCTCAAGGAGCTTGTCGCGCTGGCGGACTC
GCATCCCTCCGACCAGTAGCAGATCGTCGCTGGCGCGCAGCCGCTCGGTGCACTGCGGACAGCGGAAGCACGCCTGCACG
CGTTCGTCGTCCCAGCGCACCGCGGTGCCCGCGGTGTAGTGGCCGTCCAGCAATCGCTGTAAAAGCGCACGCTGGGACCG
GTAGACCGGGATGAGCTCGCCGACGCGGTAGCGCACGATCGTGCCGTCGCCGAGTTCGAGCTCGGCGTCGGCAGCCACCG
GAACGCCCGAGTCAACCAGCGCATCGGCATAGGCCGCCAGCTGTAGCAGCGCGGTCACGGTTGGCGAGCGGGCGAGCTTG
GTGTCGGCGACCCGGTACCGGTGACCGTCGCGGATCAGGAAGTCGGCGAACCCGACGAAGCGGCCGTCGAACATGGCGGC
CTGATACACCACCGGGGCGTGGTTGGCGATGGCACGTCGCGTCGCGTCGGCGGCTGCCGCCAGCCCGGCGGGCGTGTAGG
CCGGCCGGCCAATGATAGCCACCGCGTCGCCGAACTCGTGGCGCAGTTGGTCGAGTCGGCGTCCTTCATGCGCGCTACCG
AGAACGGCGGCTCGCGCCATCAGTTCGTCGTCAACTGCGACGGCCGGTCCCCGGCCTAGTTTCGCGTCGAATTCACGGAG
CAGTGCGTACTGGCACCGGGCGGCGGCTGCGAGATCCGAAGCACTGTAGACGATGCTGTCACCGGTGACGAACACAGCAG
CAACTCCTCGGTGAGACAACGGACAGGCAAACTGGGCTGCACCCGTCGGCTTAACCGCCGGTGGTGTTGCCGATCAGCTC
GACGCCGCCGCCGTTCCAGCGGAACTTGACAACGTTGTTCAACCCGATGCCGCTGGCATACGTCAATGCCACCGTGTCTC
CCGTGCACTGCGAGGTGTCGATGCCGGTGAACCCATAGGTATCGGGCACCCCCTGCGGTATGTACTTGCCGAGGTGGAAC
```

FIGURE 5(continued)

```
ATCACCGCGCGGGTGGTCGGATTGCCGGCGTTCGTGTTGGCCTTGATGACCACCGCCGACAGCTGGGCACACTCGTTGTA
GTTGCCGGCCAGCGGTTCTGGGTTCCAGGGCTGCTCACTGCGCGGATCGCGAGGAAGTTCGGAGACGACTTTGGCGATTG
TGGGCGAGGCGAGGTTCACCGCACACGGGTCGACCGGCGCGGCGCTGTGGTTGCTGGGTGGGGCAGCTGTCGCGGACGGC
GGGCTCGGTTCGCTGCTCGGCGGGGCCGGGTGAGCAGTTGACAGGGATGGGGTGGCCTCCGGCGTCTTAGCGACCGTCGA
GTCGCCCGAACCGCAACCGGTCAACGTCGCGGCGACCAATGCAGCGACCACGCCAACACGCGGCGTGGTGGGGCAGGGTG
GTGACCACACACCGGGCACCGTACCGCCATCGGGCCCGCGGGTGCGGTAGGCGTGGCCGGGTCACCACTAAACTTGACGG
CCTGATGGCCTTCCCGGAATATTCGCCTGCGGCGTCCGCTGCGACGTTTGCTGACCTGCAGATTCATCCCCGCGTCTTGC
GGGCGATCGGCGACGTCGGTTACGAGTCACCGACGGCTATCCAGGCGGCTACGATCCCGGCGTTGATGGCAGGCTCCGAC
GTGGTGGGGCTGGCGCAGACCGGCACCGGCAAGACGGCGGCATTTGCGATTCCGATGCTGTCCAAGATCGACATCACCAG
CAAGGTGCCCCAGGCGCTGGTGCTGGTGCCCACCCGGGAGCTGGCTCTGCAGGTGGCCGAGGCGTTCGGCCGCTACGGTG
CCTATCTGTCGCAACTCAACGTGCTGCCGATCTACGGCGGATCGTCGTATGCCGTGCAACTGGCCGGATTGAGACGCGGC
GCGCAGGTGGTGGTTGGCACCCCCGGTCGTATGATAGACCATCTCGAACGGGCGACCTTGGACCTGTCGCGGGTGGACTT
TCTAGTGCTCGATGAGGCCGATGAGATGCTGACCATGGGTTTCGCCGACGACGTTGAGCGCATTCTGTCCGAGACCCCCG
AATACAAGCAGGTCGCCCTGTTTTCCGCGACCATGCCGCCGGCGATCCGCAAACTCAGCGCCAAGTATCTGCACGATCCG
TTCGAAGTCACTTGTAAGGCGAAAACCGCTGTGGCCGAGAATATTTCGCAGAGCTACATTCAGGTAGCACGGAAGATGGA
CGCGCTCACCAGAGTGCTCGAAGTCGAGCCGTTCGAGGCGATGATCGTCTTTGTCCGCACCAAGCAGGCGACCGAGGAGA
TTGCCGAAAAGCTGCGTGCCCGAGGGTTTTCCGCGGCTGCCATCAGCGGTGACGTCCCGCAGGCGCAGCGGGAGCGGACC
ATCACGGCGCTGCGGGACGGCGACATCGATATCCTGGTCGCCACCGATGTGGCGGCGCGCGGACTCGACGTGGAGCGGAT
ATCACACGTGCTTAACTACGACATCCCGCACGACACCGAGTCCTACGTACACCGGATCGGGCGCACCGGCAGGGCCGGGC
GTTCGGGAGCCGCGCTGATATTCGTCTCGCCACGGGAGCTTCACCTGCTCAAGGCGATCGAAAAGGCTACGCGGCAAACG
CTTACCGAGGCGCAATTGCCCACCGTCGAGGATGTCAACACCCAGCGGGTGGCCAAGTTCGCCGATTCCATCACCAATGC
GCTGGGCGGTCCGGGAATCGAGCTGTTCCGCCGACTGGTCGAGGAGTATGAACGCGAGCATGATGTCCCGATGGCTGACA
TCGCCGCGGCACTGGCCGTGCAGTGCCGCGGCGGTGAGGCATTCCTGATGGCACCCGACCCGCCGCTTTCGCGGCGCAAC
CGCGACCAGCGTCGGGACCGTCCGCAAAGGCCCAAGCGTAGACCGGACTTGACCACCTACCGCGTCGCCGTCGGCAAGCG
GCACAAGATCGGTCCAGGCGCCATCGTCGGCGCCATCGCCAATGAGGGTGGGCTGCACCGCAGCGACTTCGGTCAGATCC
GTATCGGGCCAGACTTCTCGCTAGTAGAATTGCCGGCGAAGCTGCCCCGCGCGACGCTCAAAAAGCTTGCACAGACCCGT
ATCTCGGGTGTGCTGATCGACCCTTCGGCCATACCGGCCGCCCGACGCGGCGCGCCGGCATAATGGCGGCAAACCACGGCG
GAAACACGTCGGATGACCCTGCCCAAGGAAAGAGCCGCCCAGGGCGGACTCGAGCGGATCGCCCACGTGGACCGGGTGGC
GTCGTTGACCGGGATCCGTGCTGTTGCCGCATTGCTGGTCGTCGGCACTCATGCGGCCTACACCACCGGCAAGTACACCC
ACGGCTATTGGGCCTGATGTCGTCCCGCATGGAGATCGGCGTTCCGATCTTTTTCGTGCTGTCGGGGTTCCTGCTATTC
CGGCCATGGGTTAAGTCCGCCGCTACCGGCGGCCCCCGCCGTCGTTGAGCCGCTATGCGTGGCACCGGGTCCGGCGGAT
CATGCCCGCCTACACCGTCACCGTTCTGTTGGCCTACCTCGTCTATCACTTCCGCACGGCGGGGCCCAACCCCGGGCACA
CCTGGGTCGGGCTGTTCCGCAACCTCACCTTGACGCAGATCTATACCGACGGCTATCTGGGTGCGTTCCTGCATCAGGGT
CTGACCCAAATGTGGAGCCTCGCGGTGGAGGTTGCCTTCTACCTGGCGTTGCCGGCGTTGGCATACCTACTGTTGGTGCT
CGTCTGCCGGCGGCGATGGCAGCCCAGGTTGCTGTTGGCCACCATGGCGGGGCTGACGATGATCAGCCCGGCATGGTTGA
TCCTGGTGCACAACACGCACTGGATGCCCGACGGCGCTCGGCTGTGGCTACCCACCTATCTGGCTTGGTTCGTCGGCGGC
ATGATGCTGGCCGTGCTGGCGGCGATGGGCGTGCGCTGTTATGCATTCGTGGCCATACCGTTGGCGGTCATCTGCTACTT
CATCGTCTCCACTCCGATCGGGGCGCGCCCACGACGTCGCCCACAGCGCTGGCCGAGGCGCTGGTCAAGACCGCCTTCT
ATGCCGTGATCGCCGTGCTGGCCGGTGGCACCGCTGGCCTTGGGTGACCAGGGGTGGTATGCCCAGTTGCTGGCCAGCCGG
CCGATGGTGTTTCTTGGTGAGATCTCCTACGAGATCTTCCTGATCCATCTGGTGACCATGGAGATCGCCATGGTGGACGT
GCTCGGGTATCGGGTTTACACCAGTTCGATGGTGAACCTTTGTCTCGTGACGCTGGTGCTGACGATCCCATTGGCGTGGT
TGTTGCACCGTTTCACTCGGGTCCAGGGTGACCGGCCTTCCTAGCGGCGGCAGAAGCAGGTGTCACGATCGGGACGACGA
ACTCCGCGATCATCGCTCGTTCGTCGGCTTCGTCACGGCCGGGGAACATCAGCAGCGATGTGAGCATCCGGACCACCCAG
CGGGCGCGGCGTTCGACGGTGGTCGGATCGTCGGGACCTAGTGAGTTGAGGAATGCCGCGGCCAGGGCCGCGATCACCTC
GGACCGTCCGGCCATCTCGCCGCCGATCGGTGGGCGGGTGGTGGTAAACCACGCGGCCAACGCGGGGTTGTCGCGGACCA
TCCGCAACGTCGTGGTGATGCTCACCAGCAGCCGCGTTCGGCAGGTTCGACGACATCGGCGATCTTCACCATGATCTCGCGG
CCGAGCCGGCGGGTCTCGCGGTGCACGTACGCGGTTCGCAGCGCCTCGCGGCTGTCGAAGTACCGATACAGTGTTGCGCG
CGAACAGCCTGCGGCCTTGGCGATCTCGTTCATGCCGATCGACGCGGGTCACGCTGCGTAAAGAGTCGCTCGGCGGCGT
CGAGTATCCGATCTGCGGCTAACTCGGTCCGACGCGCGGACAGCCAGTCGGTACCCGCCATCAGGATGTCACTCGGAACG
GCACCGACAGCGGACGCCGGACATAACTGCCGCCGGACCACACGATGCGTGACTCGGCCACCTCGAAGTCCGGGCACCGG
GCCAGCAGTTCGGTCAGCGCCACCCGGCATTGCATCCGGGCCGCGGCCGCACCCAGGCAGTGGTGGGCGCCGTGGCTGAA
GGTCAAGATGTTGCGCGGGCACCGAGTGACATCGAGTTCGGCTGCGTCCGGGCCGTATTGGCGTTCGTCACGGTTGGCCG
AGCCGTACAGCAGCAGCACCCGGCGACCGGCCGGGATGGTGGTGTCACCGATCGTGACGTCGCGCGTGGTTGTGCGCGCC
AGCCCCTGCACCGGCGAGGTGAGCCGCAGCAGCTCCTCGACCGCGTCGGGGATGCCCTCTGGGTCATCCAGCAGCAGCCG
GCGCTGGTCGGGCCGCCGGTGCAGCAACGGCATCGAACCGCCTAGCATGCCGGTGACGGTGTCGTTGCCGCCGGTGACCA
TGGTGAACGTGAACGCCAGTATGGACAGTGTGCCGGCGGTGTCGCCGTCGGCGCCGACCCCGGCGGCTACCAGGTGGGAG
```

FIGURE 5(continued)

```
ATGGCGTCGTCGGCGGGCTCGGTGCGGCGTCGCTCGATCAGCCCGGTGAAGTAGGCCATCATCGAGCCGACCGCGTCCAG
TGCGCCGGTGGTGGCGCCGTCAACCGCGTTCGCCGCCACGATGGCCTGGGTCCACCCGTCGAATTGCGTCCAATCCTCTT
CGGGAACACCGAGATAGTGCGCCACCACCATCGACGGGAGCGGTTTGAATAGTTCGGTGACAATGTCGCCGCCACCGTTG
GCGCGCAGCTTTTCGAGCCGCTCAACGACGAACTTGCGCACCGTGGGCTCGACGGTTTCGACCTGTCGTGGCGTGAAGCC
GCGCGACACCAGCTTGCGAAACTCGGTGTGGACCGGCGGATCCTGCATCACCATGGGCGGGGTGTCGTGCAGTCCAATCA
TTTCCAGCTCGCCGTAGTTAACGGTCAAGCCTTGCGCCGACGAGAACGTCTGATGGTCCCGCGCTGCCGACCAGACGTCG
GCGTGCCGGGACAGCACGTAGTAGTCGTACTCGGGACGCTGCGGCGGGACGACGTGGTGCACCGGGTCGTGGTCGCGCAA
CGCGCGGTACATCGGCCACGGATTCGGCCAGGTTTCGGCGGTGGCGAGCTGGAATTCGTGAGACATTACTGATGTCATGT
CTTATGTCTAAGACATTCCATCGGTAATATCAATCGGCGATTGTGAATCTGGTGACGCGACACGCCGAGGACGCGTCGTG
CGGTTCACACTCGGCGGGACGTCGCGACGGATCAGATCGCCGAGCCGGGATTGAGGATGCCCTGGGGGTCCAGCGCTTGC
TTGATGCGCTGGTTGAGGGCCAGGACGTCGGGCCCGAGATAGCCGGCCAACCACGGCCGTTTCAACCGGCCCACGCCGTG
TTCGCCGGTGATCGTGCCGCCCAGGCCGACGGCCAGGTCCATGATTTCGCCGTACGCGAGGTGGGCGCGCTCTAGCATCG
CGGCATCTGCGGGGTCGTACACCAGCAACGGGTGGGTATTGCCGTCCCCGGCGTGGGCGATCACCGAGATCATCAGATTC
CGCTCCTCGGCGATGCGCGCAATCCCGGTGACCAGTTCGCCCAGTGCGGGCAGCGGTACCCGACGTCCTCGAGCAGCAA
CGCCCCCTTGCTCTCGACCGCCGGAATGGCGAACCGCCGGGCCGCAATGAACGCCTCGCCCTCATCCGGGTCGTCGGTCG
AAAACACGTCTATCGCACCGTTTTCGGCGAACACGGCGGCCATCACGGCGGCGTCTTCGGTGGCCGCGCGGCCACGTTCA
TCAGAACCAGCCACCAGCATGGCCGCCGCATCGCGGTCCAGGTCCATCCGCAAGGTGTCCTCGACGGCGTTGATCGCCAC
CGAATCCATGAACTCCAGCATCGCGGGGCGAAGTCGGCCGGTAACCCCGAGCACCGCATCGACCGCCGCCTGCACCGAGC
CGAAGCTGGCCACCACGATGCTCGATGCATTCTGTGCGGGCAGCAGTCGCAACGTCACCTCCGTGATGACGCCCAGCGTG
CCTTCGCTGCCGACGAACAGTTTGGTCAGGGAAAGCCCGGCGACGTCCTTGAGCCGTGGGCCGCCCAGCCGGACCGCGGT
GCCGTTGGCCAGCACAACCTGCATGCCCAGTACGTAGTCGCCGTGTGACGCCGTACTTCACGCAGCACAGCCCGCCGGCGT
TGGTGGCGATGTTGCCGCCGATGCTGCAGATCTCGAACGACGACGGATCCGGGGGATACCACAGGCCGTGTTCGGCGGCG
GCCTCCTTCACCTCGGCGTTGTACAGGCCGGGCTGGCACACTGCGGTGCGGGTGACCGGGTCGACGGTGATGTCGCGCAT
CTTTTCGGTGGACAGCACGATCCCGCCATCCAGGGCGGTCGCCCCGCCCGAAAGGCCGCTACCGGCTCCTCGGGTCACCA
CGGGCACCTGGTTCGCACTGGCCCAACGCAGCACCGTCTGCACCTCTTCGGTGCGCCGTGGCCGGATGATTGCCAGCGGT
TTGCCGGCCGAAGGGTCAAAGGCCCGGTCTTGCCGGTGAGCCGTCGGTGACGGCGGGGTCGGTGACCACCATCCCCTCGGG
CAGCTCGGCCATCAGGCCAGCCAGCACATCGGGTATTCACTGAGCCGATCCTACGGGCCGATCGATGTCCGCTTGGGGCGC
CAGATCCAGTTCGCGCAGCGCGGGCAGCCGGATCGCGACCAGCCCGGTGCACACGATGGGCAGTGCCAACGCGAGAAACG
TGGCATGCAGTCCAGCGGCGTCGGTCAGTGGACCGGCCAGCAACAGACCCAACGGGCCGGCGGCGTAGGCCAGCGACGTC
ATCACCCCGACTACCCGGCCGCGCAGATGCTGTGCTGCCCGCGTCTGTATCACGTAGTTATAGATCGGCTGGATGGGTCC
GTACACCAGGCCGACCACCGCGCACAACACCATGATGACCGGCAGTGGCGGCAGGAACGCGATGACCATCGATGCCAAAC
CCAGGGTAAGAACCGCGGTCGACATGGTCACGCGACGGGGAACGCGGATAGCCAACACGGCATACCCCAGCGCTCCCACC
AGGCCGCCGCCGGCGATCGCCATCAACGCCCAACCCAGCTGCACCGGTTGCTGGTGGTCGGTGAAGTATTTCGGGAACAG
CACGCTCTCCATCGGCAGATACAGCGCGGTGACGGTCAGGTCAATCATCCCGAGGGTGCGCAATACCCGCAGGTTCCAGA
CGAAGCGCAGCCCCTCGGCGATCCCGGATACCAACCCTTGGGGCCGCGAGGTGTGGTGCGGCTTGCCGGCACCCTCGAGT
TGCAGGGCGGCAATCGCGAGGATGGACAACCCGAATGCCGTCGCGGTAATCCACATTGTGGTGATGCCGCCAACCGTCGC
GATCATCAAGCCACCGATGGCCGGGCCGACAATAAAGGCCAGGTTGAGGATCGCCTCGTAGGCGCCGTTGATGCGGTCCA
ACGACCAGCCTGCCCGAGCGGCGGCCTCGGGCAGCATCGAGTCACGAGCCGTCATGCCTGCCGGGCCGAAGGCGGCCGCC
AGGGCGGCCAATACGGCCAGCACCAGCACGTTGACCGCGTCGCCGCCGTACCCCACGCCACCAGGGGGACGCCGGCCAC
CGCCGCACCCGACAGCGCATCGGCCACCATCGACACCCGGCGACGCCCGAAGTAGTCGACCGCGGTGCCGGCGACCAGCG
TGGCGAACAACAGCGGCAGCATGGTCGCACTGGCCACGATCGAGGCCTGCCCAGCGCTGCCCTCGCGCTGCAACACCAGC
CACGGAAACGCGACTATCGAGACGCCATCACCCGCGGCCGCCATCAGCGTTGCGAACAGGATCAGGAATGCCGGGCCGCG
GTTGCTGTTTCTCATGAATATCGCGGCTGAATCTAGCGCCAAACCGGTATGGGGGCCACCGAATTTCTGCGCTGCCGCAG
CCCGGATGCAGGATGTTCGTGTGCTCATGCATCCGAAGACCGGCCGGGCGTTCAGGTCCCCGGTAGAGCCCGGTTCCGGC
TGGCCAGGTGATCCGGCGACACCGCAGACCCCGGTGGCTGCCGATGCCGCGCAGGTGTCAGCGCTGGCCGGGGGACGTGG
CTCGATCTGCGAACTCAACGCGCTGATCAGCGTGTGCCGGGCGTGTCCCGGCTGGTCAGTTGGCGTGAGGAGGTCGCCG
TCGTCAAGCGCCGTGCCTTCGCCGACCAGCCCTACTGGGGGCGCCCGGTGCCGGGGTGGGGTCGAAGCGGCCGCGGTTG
CTGATCCTCGGGCTGGCGCCCGCCGCGCACGGGGCCAACGGACCGGACGAATGTTCACCGGCGATCGGTCGGAGATCA
GCTTTATGCAGCACTGCATAGGGCCGGCCTGGTGAACTCACCGGTCAGCGTCGACGCCGCGGACGGGCTGCGGGCCAACC
GGATTCGGATCACCGCACCGGTGCGGTGCGCCCCGGGCAACTCGCCGACACCGGCCGAGCGGCTGACATGCTCACCC
TGGCTAAATGCGGAATGGCGGCTGGTGTCCGATCACATCCGTGCGATCGTCGCCCTCGGCGGGTTCGCCTGGCAGGTCGC
GTTGCGCCTGGCGGGCGCGTCGGGGACACCCAAGCCGCGGTTCGGCCACGGCGTCGTTACCGAGCTGGGAGCCGGTGTGC
GGCTACTGGGCTGCTACCACCCGAGCCAGCAGAATATGTTCACCGGTAGGTTGACTCCTACGATGCTCGACGACATTTTC
CGTGAGGCCAAGAAGCTGGCCGGGATTGAGTGACGTGAAGACGGTTGTGGTTTCCGGCGCCAGTGTGGCCGGTACGGCGG
CGGCGTACTGGCTTGGGCGGCACGGCTATTCGGTAACGATGGTGGAGCGCCATCCCGGGCTGCGACCAGGGGGCAGGCT
ATTGATGTCCGAGGTCCGGCGCTGGATGTGTTGGAACGTATGGGGTTACTGGCAGCCGCCCAGGAACACAAGACGAGGAT
```

FIGURE 5(continued)

```
TCGGGGCGCCTCCTTCGTCGATCGTGACGGCAATGAGCTGTTCCGGGACACCGAATCGACGCCCACCGGCGGTCCAGTCA
ACAGTCCCGATATCGAGCTGCTACGTGACGATCTTGTCGAATTGCTCTACGGGGCAACTCAACCCAGCGTTGAATACCTG
TTCGACGACAGCATTTCCACATTGCAGGACGACGGCGACTCGGTGCGGGTGACCTTTGAGCGCGCGGCGGCCCGCGAGTT
CGACCTCGTTATCGGTGCCGACGGACTGCATTCCAACGTGCGCAGGTTGGTTTTCGGTCCGGAGGAGCAGTTTGTCAAGC
GATTAGGAACTCACGCGGCGATTTTTACCGTGCCCAACTTCCTGGAGTTGGACTACTGGCAGACCTGGCATTACGGTGAC
TCCACCATGGCTGGCGTTTACAGTGCGCGCAACAACACCGAAGCCCGCGCTGCACTAGCCTTCATGGACACCGAACTGCG
GATCGACTACCGCGACACCGAAGCTCAGTTCGCCGAACTGCAACGTCGGATGGCCGAGGACGGCTGGGTGCGCGCGCAAC
TGCTGCACTACATGCGCAGCGCACCGGATTTCTATTTCGACGAAATGTCGCAGATCCTGATGGATCGCTGGTCGCGGGGC
AGGGTAGCGCTCGTTGGCGACGCTGGTTATTGCTGCTCGCCCTTGTCGGGGCAGGGGACCAGCGTCGCCCTGCTGGGTGC
CTACATCCTGGCCGGCGAACTCAAGGCGGCCGGTGACGACTACCAACTCGGATTCGCCAATTACCACGCCGAATTTCACG
GCTTTGTCGAGCGCAACCAATGGTTGGTCAGCGACAACATCCCCGGTGGTGCGCCGATACCGCAGGAGGAGTTCGAACGA
ATCGTGCATTCCATCACGATCAAGGACTACTGAGCGCCTTCACCCGGGCGCAGCCAGGATGGCGCTCGTCGGCCGCTTCA
CCGAACCTGAAGATCTGCAGACGAAGTACGAGTAGGGGCCGGCAAATTTACCGGCTCGACGCGCAGAAGCGCCGAGATTT
AGCGGCGGGTCAATACGACGACCGGGATTGGCCGTGACGTCCGGCTCTGGTAGTTGGTTGGCGTTGTTCTCG
TTGACGATCTGCCAGAGCCGCGCGTAGTCCGGGTCGTGGGCGTGCACCGGTTTCGCTGTCACACCGAATCGCTTGGGCCC
GACGTTGATTTCGACGTCCGGGTTGGCCTTGAGGTTGTGGTACCAACCCGGCGAGCGGGGATCGCCACCTTTGGACGCCA
CGATCAGGTACGCGTCGCCGTCGCGAGCATAGGTGAGTGACGTGGTTCGCGGCTGGCTCGTCTTGGCGCCGGTGGTATGC
AGCAGCAAACTCGGTGGCGCGCCGGGGATTCGGTGTCCGATCCGACCGTTAGTGCCTCGGTAGATCGCGTCGTGCAGCCT
GAGCAGCTGCACGCCTACGTGGCGCTCAAGCCATCGGGAAATGTCCATGGGGTCAGTCTTGCGCAGCGGCATCCTGTTGC
GCCAGCGCCTCCCGCAGGATCCGTCCGGTGGCTTCCCGGTCCGGGTCGCGGCGCAGCATCATTCCCTTGGCGACCGACAG
CTTGTCGCCGTTGCGCGGCGGTAATACGTGCAAGTGAACGTGGAACACCGTCTGAAAAGCGGCACGGCCGTCGTTGATGG
CGATGTGTGTCGCGTCAGCCAACTTCGTGGCGCGGGCCGCCCGCGCGATGCGTTGGCCGATGGCGACCATGTCAGCCAAC
GCCTCCGGCGGGGTGTCGGTGAGGTCAACGGTGTGTCGCTTGGGCAGCACCAGCGTGTGGCCGCGGGTGAACGGGCGGAT
GTCGAGGATCGCGAGATAGCCGCCGTCCTCGTAGATCCGGATGGCCGGAGCCTCCCCGGCGATGATCGCACAGAACACGC
AGGGCATGTCGCTACGGTACTGGACCTCTCGGAGACCGCCCAAGTGAACGGGATACGCTGCCGCCGTGGACCCTACTGAC
CTGGCCTTCGCCGGTGCCGCGGCACAGGCGCGGATGCTGGCTGACGGTGCACTCACCGCGCCGATGCTGCTCGAGGTCTA
CCTGCAACGAATTGAGCGTCTGGACAGCCACCTGCGCGCCTACCGGGTGGTGCAGTTCGACCGGGCGCGTGCGGAGGCCG
AGGCCGCCCAGCAACGCCTCGACGCCGGTGAGCGGCTGCCGCTCCTGGGCGTGCCGATCGCCATCAAAGATGATGTCGAC
ATCGCCGGGGAGGTGACGACATACGGCAGCGCCGGGCACGGTCCGGCCGCGACGTCCGACGCAGAGGTGGTTCGCCGGCT
GCGCGCGGCAGGCGCTGTCATCATCGGCAAAACCAACGTGCCTGAGTTGATGATCATGCCCTTCACCGAGTCGCTGGCCT
TCGGGGCCACCCGGAATCCGTGGTGCCTCAATCGAACCCCTGGCGGCAGCAGCGGCGGCAGCGCTGCGGCGGTAGCGGCC
GGGCTGGCGCCAGTGGCACTGGGATCCGATGGTGGCGGATCGATTCGTATCCCGTGTACCTGGTGCGGTCTGTTTGGGCT
GAAACCACAGCGCGATCGGATTTCCTTGGAGCCGCACGACGGGCCTGGCAGGGGCTGAGCGTCAATGGCCCGATCGCGC
GGTCGGTAATGGACGCGGCGTTGCTACTGGACGGCGACCACAACGGTGCCTGGTCCCGAAGGCGAGTTTGTGGCCGCGGCC
GCACGCCAACCCGGCCGGCTGCGAATTGCCTTGAGCACCAGGGTTCCAACCCCGCTGCCCGTTAGGTGCGGCAAGCAAGA
ACTGGCAGCCGTCCACCAGGCAGGTGCGTTGCTACGTGATCTGGGCCACGACGTCGTCGTCCGCGATCCCGACTATCCGG
CTTCGACCTATGCCAACTACCTGCCCCGCTTTTTCCGCGGTATCAGCGACGACGCGGACGCGCAGGCGCACCCGGACCGC
CTCGAAGCACGTACCCGAGCCATAGCGCGTCTAGGGTCGTTCTTCTCCGACCGGCGGATGGCGGCCCTGCGGGCCGCCGA
GGTGGTGCTGAGCAGCCGGATCCAGTCGATCTTCGACGATGTCGACGTAGTTGTGACGCCAGGCGCCGCGACCGGCCCGT
CCCGCATCGGCGCCTACCAACGCCGGGGTGCAGTTTCGACGTTGCTGCTGGTGGTGCAGCGGGTTCCGTACTTTCAAGTC
TGGAATCTGACCGGCCAGCCCGCGGCCGTGGTGCCGTGGGACTTCGACGGCGACGGCCTGCCCATGTCGGTTCAACTCGT
CGGCCGGCCGTATGACGAGGCGACGCTGCTGGCACTGGCCGCACAGATCGAATCTGCCAGACCCTGGGCCCATCGGCGGC
CGTCGGTGTCATGACATTGCAGTCGCCCGCTCGTTTTTCACGTTTTTGCCCGGCCGCAGGACATGTGCGGCGGCGTTAAC
GTTGACTGGTGACAGACCACGTGCGCGAGGCGGACGACGCGAACATCGACGATCTGTTGGGCGACCTGGGCGGTACCGCG
CGCGCCGAGCGTGCGA
```

FIGURE 5(continued)

```
AAGCTTCCACAGGTAGGGATCGAGGAACAGCGCGTTGAACTGATAGGTGCGGCCCGGCTCGAGCAGGCCGGCCATTTGTT
CGATGCGGTTACCGAAGATCTCTTCGGTGACCTGCCCGCCGCCGGCCAGCTCGGCCCAGTGCCCGGCGTTGGCCGCCGCG
GCGACGATCTTGGCGTCCACGGTGGTCGGGGTCATGCCCGCGAGCAGGATCGGCGAGCGGCCGGTCAGCCGGGTGAACTT
CGTCGAGAGCTTGACCCTGCCGTCGGGGAGGCGAACCACGGTCGGTGCGTAGCTCGACCAGGCCCGGGCAACCTCGGGGG
TGGCGCCGACGGTGAACAGGTTGCGCTGGCCACCGCGGGTAGCCGCCGGCACGATGCCGATGCCCAGGCCGCGGATCACC
GGTGCGGTCAGTCGGGTCAGGATGTCGCCCGGCCCCAGGTCGAGGATCCAGCGGGCGCCGGCCGCGTGGACACGGGTGAT
CTCGTCGACCCAGTCGACCTTTCTGATCAAGATGGCATCGGCCAGCTCCCGAGCCAAGGCGACATCGAGGCCCGCCTTCT
CGGCCCAGCCCGCGACGATGTCGATCCCGTCGGATAGCCGCGGGGTGTGAAAGCCCACCTCACCTGCACCGGCTCGAAG
ACCGGCGAGAAGACGTCGCCGCCGCGGACCTTGTTCTTGCCGGTCGGCTTCTTCCTTCTCGGAGATCTGGCGGCAATAAAG
CTCGAAACGCGACAGCTGCTCGGGGGTGCCGGTGATGACGACGGCACGCCGGCCGTTGCGGATGGACAACACCGGTGGCA
GCACCGTGCGCACGTCCTGGGCGAACTCGTCGAGCAACCGGCCGATGCGCTCGGGGTCGGCGTTGGTGACCGATACCATC
GGCGGGCGATCGCCCAGGACGGAAATTCCGCGCCGGCGGGCCACCAGCGTTCCGGCGGCACCGATCAACTGGGCCAAGGC
AAACAGCTCGACGTCGCGTGCCCCACCAGCCTTGAGGGCTTCCACCGCCAGCACACCTTGCGAATGCCCCGCCATGGCGA
CCGGCGGGGTGGCCACGAGGTCCATGCCTTGACGGGCCAGCGCCCGGGTCGCCGCGATCTGGGTAAGCAACACGCCGGGC
ACCGACACGGCGGCCGACGTCAGGTGCTTGTCGGACGGAACCGGGTCCTCGGCCGCCAGTGCGCGTACCCATTGCAGCGG
CTCGAAACCGATCGGGCGCACCACAATCAGCTCGTCGGTGACCGGATCGAGCAACAGCTCTGCCTCACCGACCAACGTCG
CCAACTCGGTTTCTATCCCGGTGGCCGACACCAGCTCTTCGAGGGTTTCCAGCCAGGCGCTGCCCTGGCCACCGAATGCG
ACAGCGTAGGGCTCACCAGCCATGAGGCGATCGACCAGAGCGTGGGTGGTATGCGGGCTGTCCCCGCCGCGATCAGCGGA
CACCCGGTCGTGCTCGTGGATCGTCACGGTCTATGTCTCCCTATGTGCATCGGTACGTGTCAGTTCGTACAGCGGCCCAG
GCTGCCGTGCGGGCATCCCCGACTCCGCACCGACTCCCAGCCGAAATCCTCTGACCGGTGTGTTGTCGGTGGGCCGGCC
CGTGGGTCGAGCAGCGCGACGGGCTGCATCGGCCTTATAAGAGTCTCATAAGGATCGGTCCACCTTGTTTACACAGATCG
GTTACTGGCGAGTTCTACGTACGGGTAACCGTGTCGTGGGTAACGCCGGGTTCGACGGCCGGCGCGTATGTGTTGACCAA
ACGTCCTGCGTGCAGGTGGTTACGGTGGAGTAGCTATAACTGCGCTGATCAAGGCAGTTTTGTTATCAAATCGTTATGCT
GGGAATTCGCTCTACGCCGGGCGCGTGCCGACGCGCGACCCAAAGGCCGCGCCCATTGGCGGCGTTGGCCCGGGGTTGGC
AATGCCGTGCAGCGGGCGAACGAGTGTTTGCTGTAGTGCAGCGGGGGCCAGGCTCGGGGCGGCAGGCTAAGCCCACTGCC
CGAATTGGGGCTTCAGGATTTGGTTGACGTCCACCCCGACCCCACCAACCTTGCGCTTATCGATCTCCACCTGGTGCAGA
TGCGCGGCCGGGTGGGTGTATCCCTTGGGCGAGCCCCAGTTGTGCTGCCAGAAGTACGAGCCCAAGCCATCGTTGACGGC
CCAGTCGATGGTTTTGGAGTTGGCGTACACGCCGGTCCGCTGGTGTCCGATCACCGACTCCCAGGACCGCAGATATGGCA
CGATCTGGTTCTTGTACTGCTCATATGATGGGTTGTCGTCGATCGAGGCGTAGATCGGGGCGCTCGTCGGGCCGCCGGCA
GCGGCATGCAGCTCCGACCCCCGTCTGGCGTGCTGCAGCCGGCGTGGCACCGCCCAGTCGGCAGTGCTCCCCTT
GCCGTATTGATAACAGGACACGATCTTGAGCCCATTGCCGCTCAGGTCACGGGCCTCGCTGAGCTGGATCGGCTTGCCAA
GCATCCAGGCGCCGCCAGGCCGCCGATCGGACACGTACCGGATTGCCCCCACCGCGCCGGCAGCCCTGATCTGGCTGGCG
GGGATGACACCGGCGGCGTAGTCCAACAGGGTGCCCAGCGAACCGGCCGATGCCGGCGCGGCGCGCAACGACGACGCAAC
GACGCCAAGACCCAGCACGCCCGGAGTCGCCGCCGCGAATTTGAGCACATCACGCCGAGAGACCGACATATGCCACAGGG
TACGACAAAAACAACAACTGTCACACTGGTTTCAGTGGTCACGGATGCATCACACTGGCAGAACACATGCATGCGGCCAT
ACCGACACCGGTGCGGTCTCGGGCAGGCCGCCTCTCCCTGCCGACCACTACTACGGTGTGATCGCCTACGCTCCCAACGG
GCAATGGGCAAAATCGTCGCGCCACCGCACTCGAGGCCAGGCGGATATCGACGCATAAGAACTTTGCGGCGTCTTAGCTG
CAAAGTGCTCAGCAACTTCACCAACTACCACGGGGGAGTCCGACGATCGCGCCCGCTGGCAGAACCTGGACGTGCAACCA
GTTGAGTAGTTCCCACACTGCGCGCCGAGCGTGGGCTGGCTGCGCCGAATGTGCACTGGTGGCGGCGACACGCCCGGGCG
ACGCCGCCGTGGTTGCACGTTCGGCGTAGGCAGCCCCGTGCGCTTGCCGGGCAGGTGTCCTCAAAGGTCCAACTAGACAC
ACATATCAGACACTAGTATGTACATATGACCGTAAAGAGGACCACGATTGAGCTGGACGAAGATCTTGTGCGGGCAGCCC
AGGCCGTCACCGGGGAAACATTGCGAGCGACGGTCGAGCGCGCGCTGCAGCAGCTGGTGGCCGGCTGCCGAGCAGGCC
GCCGCGCCGGCGGCGGATCGTCGACCATCTCGCGCACGCCGGCACTCACGTGGACGCAGACGTGCTGCTCTCCGAGCA
GGCGTGGCGATGACCACCTGGATTCTGGACAAGAGTGCCCACGTGCGACTCGTGGCCGGCGCCACGCCGCCAGCCGGCAT
CGACCTCACCGACCTCGCCATCTGCGATATCGGCGAACTTGAATGGCTGTATTCAGCACGGTCAGCTACCGACTACGACA
GCCAACAAACGTCACTGCGCGCCTATCAAATCCTTCGCGCACCCAGCGACATCTTTGACCGGGTTCGCCACCTTCAGCGC
GACCTAGCCCACCACCGTGGGATGTGGCATCGAACGCCGCTTCCGGACCTATTCATCGCGAAACCGCGCTTCATCACCG
GGCCGGCGTGTTGCACCACGACCGTGACTACAAACGAATTGCCGTCGTACGCCTGGGTTTCAAGCATGCGAACTCTCTC
GCGGGCGCTAGCTTCGCCCGAATCCGTGAGCGGAGGCGATAATCCTTACAGGCCATCAAAAAAGTCCTCGTCGAGCCGTA
AGAGTTCGACGGTCTGCACCGCCTGGACACCGACTCGATACCGCACGAGCAGCTCGGCCAGCCGAGCGCCGTCGATGAGT
TCGATCCGGCGTTGATCCGCTCAGCTTCCTCGCGGGCACCGCGGGAAAACGATGACGTGGTGATGTAGACGCCCGGTC
GCCCTGCTTGCCCAGGAGGGCGCCGGCGAACTCGTGGATCTTCGGCCGGCCAATCGTTTGGTCGACGGCGTATCGCTTGG
CCTGCACGTAGATGCGGTCCAGCCCGAGCGGGTCCTGGCTGATGATTCCGTCGATGCCAGCGTCACCGGAGGCACTCGTC
CGTTCCACCGCGCCGGCTCGCCCGTAACCCATCGCCTCCAAAAGTCTGATAACCAGATCTTCAAACCCGGTGGGCGACAA
CGTGAGTGCCTTCTTCAGGATCTCCCCCTCGACGGCTGCCCGGTTCTCCGCAAGCGCAGCGTCGATGAGATCCTCGGGTG
AGACCTGCACATCGTCCCCGGACGGTCGCTTGGCGGTCGCGTCGACTGGCTGCTTGGCTTTGGTTCGCTCACGAAAAGCG
```

FIGURE 6

```
ATGTACGACGGGAACTCCCGCAGCACAGCCATGTCGACGCGCTCGGGATGCGCCTTCAGGACTTGACGGCCCGTGTCCGT
GACCTGGACGTGGCCCCGCGTGGGACGGTCGAGCAATCCGGCCTGCGACATGTGAGTGAGAGACCAGTGCACCCTGTCGT
ACATGGTCCTTTGCCGACCGCTGGGCAACATCTGCGCCCGCTCGTCGTCGGACAGACCGAACTCGTCGGACATCGCCGCG
ATGACGTCCTTGGCCGACTTCGCTTGTCCATCGGCAAGATACGCGAGAATCGGCCGCATCAACGTCTGGGCATCAGGGAT
CGTCATGGGGAGCCATTATCCAGCTGGCTTGTCAGCCCTCCGAACCGGCCAAGTTGGGTAAGTCCATCCGGGGCTCCGTG
TTCTGACAGGCCCGCTGCAGGCGTCGCATCTTCCTCATCTGCCCCACGTGTACCCGGTCCCGCCGACCTAAAAGGTCGGC
ATATCCCTGCCATGCCGGGACGCGTGAGGCGGGTGAGACACAAGGGAACGTGCACCTCGCGCACCGGGTCGCCAGCAGCC
GCGACACGCCGTCGTCCAGTGCCACACCGAATGCGGTGTCGGGCTCGGCGTCAAACGCTGCCGATCGGCCTTGCCTCGTC
AGGCCGCCGACAGCACCGCCCTGGGCTCACGGTCCGCGGCTCCGCGGGATCCGACCGGCGGCGGCTCAACCCCCTCGAT
CGTCTTGAGCCGGTCGACAGACCGATCGAAAGACGGCCACCGGATCGTCCCGGCAGGGCGAGGAAGTCCGGCGTCCGAG
CAAGCACCGGGCGATTGCCCTCAACGCGGAAGACAACCCGATCACCCGATTGCAGGCCGAGCGCGTCGCGCACCGCTTTC
GGAACCGTCACCTGCCCCTTCGACGTGACGATGGGTTCGTCGGAGTGCCTGCTTCACCGTTGCCGTACGCCGCCCGTACC
CTCACACTCTGTGGAGCTGCTCGTCGCCGCCAACCCCGCTGAAGACTCGCGCCTGCCCTACCTGATCCGGCTGCCGGTGG
GCGCGGGACTGGTCTTCGCCACCTCAGACGTGTGGCCGCGCACCAAGGCGCTGTATTGCCATCGCCTCGACATCGCCGAC
TGGCCCGCCGACCCCGTCGTCGTCGACCGGGTCGAGCTACGCAGCTGCAGCCGCCGGGGCGCGGCCATCGACGTCGTCGC
CGCCCGCGCGGGAGAACCGATCGCAACTGGTGCACACCATGGCGCGCGGCCGCCAGGTGGTGTTCTGGCAGAGCCCCA
AAACGCGCAAACAGTCGCGGCCGGGCGTGCGCACCCCCACCGCCCGCGCCGCCGGCATCCCCGAGCTGCACATCGTCGTC
GACGCCCACGAACGCTACCCCTACACCTTTGCCGACAAACCCGGAAGACGACGCGGGAAGCCCTGCCCTGCGGCGACTA
CGGCCTGAAAGTGGCCGGCCAACTCGTGGCGGCCGTCGAGCGTAAAGCGTTGGCGGACCTTACTTCTGGCGTGCTGAACG
GCAACCTGAAATACCAACTGACCGAACTGGCCGCGCTGCCACGGGCCGCCGTGGTGGTCGAGGACCGCTACTCGGAGATC
TTCGCGCACTCCTTCGCCCGCCCGACGGCGATCGCCGATGGGCTGGCCGAATTGCAGATCGGCTTTCCCAACGTGCCGAT
CGTGTTCTGCCAAACCCGCAAGCTCGCCCAGGAATACACCTACCGCTATCTAGCCGCCGCCCTCACCTGGTTCGTCGACG
ATGCCGACGCCACCACGGTTTTCGAGCCGGCTGCCGCCGAGCCCGAGCCCGACCAGCGCCGAGCTGCGCGCGTGGGCCAAA
AGCGTCGGCCTGCCGGTGTCCGACCGGGGGCGCCTGCGCCCGACGATCCTGCAGGCCTGGCGAGCCGCCCATCCCCGGTG
ACTACAACACCTCGACGAGGCCTGCCGGATGCTGAATCGGCCAGTGCGGCATCGAATGTGACCAACCGGCCCCCGTAGCGC
GCGGCCAAGGCGATGAGATGGCAGTCGGTGACCCGACGGTGGTTGGACACCGCATCGCGATCGCCGGCGCTCCCAACGAT
CAGTGGCACATCGTCAGGCCAAAACGTGTGCCCGGCAAGAGAAGTCATCGCCGCCAACTGAGCGATCGCGATAGCCGGCG
TGGTCGACACCTGCATCACACTGCGATTGCTTGAAATTCGGACATACCCTGCCTCGGTGATCGGCGTGGTGGCCCACCCA
TTCGAGGAGAACTGCGTGAACCATCGCTGCCGGCCGCATGGTGAACGTGATTCGGCCAGCCCAGCGCGATCAGCACATT
GACATCGAGCAGTGCCGTCACACGTCGTCCTCGAGCGCGCGGACGACATCCTCGGAAGTCACCGTCGGCGCATCCGGCGG
AACATCAAAAACCGGAAATCCGTCAACCTCGACAATCCCAACCGGACGGAGCGACCTACGCGCCAACTCAGAAATTACCG
CGCCGACTGACTTGCCCTCCGACCGCGCGATGCTACGAGCATCTTCTAGAACATCATCATCAATCTGCAACGTGGTGCGC
ATAGCATCATGTTACGGGGCTTGGGCCAGCTTTCACGCGTCTTCGGCGACCCCCTGCAGCACACTGTCGCCGTTGACGGT
GCCATTCAAAGCCGAAGCGTCCCGCGGTACCTCGAAGGCCGGCAGCGCGGCACCTACCGTGGCGACGGCGTTGCGCGCGG
CCTCCATCCGGGCCAATGCCGCCTGGGTGAACACCGACAACCCCAGGTCGGGGTTGTATCCGTGGATCTCTTTGACGTCG
AGCTGGGCAAGAAAGTAGATGATCTCCTTGGAAACCAGTTGACCCGGCACCAGTACCGGGAAGCCGGGCGGGTAGGGCAC
CACGAACGTGGTGGATACCAGAGTCTTGCCCTCAGCCAGCCGGCGCCCGGCCAAGCCGATCTGCACGTACTCACGGTCGG
CCTCTTCGTAGCCGGCGTAGAAAGCCGACCGCATGTCACCGAAAGAGCTGGCGTCGTCGGGGCGGAAGGCAAGGTCGAAC
TCGCTGAAATCGGTAGATGCGGCAGATCCTGCGTGATCTCCTCGACGTGGCGTCGGTGTAGAGCAAGGTCGGCCCCGCT
GGCCGCCTTCTGGCTGCGGTCCAGATCGATCGCCACCCGACGCAACACATCGAGCAGATAGTGCACGCTCGACCAGGTGA
CGCCGATCGTGAAGATCAGCAACACGCTGTTGATAGACGTTTTGTTGATCTGGATGCCGAATCGCTCCATCAGGATCTTC
TCGCGGAAGTCGTACCCGTTCATCCCGGTCGCCCCGATAAACAGGGTGAGCCGCGTCGGATCGAGCACGAATTGATCGGA
CCGCCAGGCTTCGTTCCAATCGGCCAGAGCCCCCTGCCTGACCTGACGGTACGAGCTGACCGTCGAGGACCGAAAGGCAT
CGGGAACCAGGTCGGACTCGTCAAGGATGCGGAACCACTTGCTGATCAGCCGGTCTTTGCGGACGCGATGGCGGAACACC
AGCGCCATGTTGTAAACATGGCGGACCAGCTCGAACCCTTCGATGTCAACCTGTCGGCGCGCCAAGTCCAACGAGGCGAG
AAGTTGCTGGTTGGGCGAGGTCGAGGTGTGGGTCAAGAATGCCTCACCGAACGCGTCCCGGGTGAGCGCTTTGAAATCCT
GGTCGCGCACGTGGATCATCGATGCCTGCCGTAGCGCGGACAGCGACTTGTGAGTCGAATGCGTCGCATACACTCGGACC
CGAGCGCGGTTGGGGTCTGGCAACAGCCGGTGATCAACCCACTCGGAGCGGTCCACTCCGTCCATCGACGCACACCAATT
CCGGTATTCCTCAGCGTATTCCGCAGTGGACAACATCTGCTCGAGTCGCTCGGCAGCAATCATCGCGGTCCGCTGCCGGG
CCCAGGGCACCGCCGTCGCAAACGCATACCACGCCTCGTCCCACAAAAAGCAGATGTCCGGTTTGATCGCTAGCACCTCC
TCCATCACCCGGCGCGGGTTGTACACCACGCCGTCAAACGTGCAGTTGGTGAGCAACAGCATGCGCACCCGGTGCAGCTG
TCCGGCGGCCTCGAGGTCCAGCAGCGCCTGCTTGATGGTGCGCAACGGCACGGCACCATAAATCGCGTACTGCGGCAGCG
GATATGCGTCGAGGTACATCGGGTACGCGCCGGCCAAGTACCAGGCCGTAGTGGTGCGACTTGTGGCAATTGCGGTCGATG
AGCACGATGTCGCCGGGGCGGGCCGGGTCAGGGCCTGCACGACGATCTTGTTGGCGGTCGATGTTCCGTTGGTGACGAAGTAGGT
CTGGTTGGCGTTCCAGGTCACCGCGGCTTTGTCCATCGCCGTCTTGATGTTGCCATGCGGGTCCAGCAGCGAGTCCAGTC
CACCAGAGGTTGTCGAGGTCTCGGCCATGAAGATGTTGCGGCCGTAGAACTCGCCCATGTCGTGCAGTGACTTGGAGTTG
```

FIGURE 6(continued)

```
AAGATGCTGGCGCCGCGCGCGACGGGAAGGGCATGAAATTGGCCGACCGGCGCCGCCGCATAGGCCCGCAGCGCATCGAA
AAACGGTGTGGCATAACGGTTTCGTAAACCCGCGAGCACCGTGCTGTGCAGGTCGGTGACGTCGTTGAGCCGGTAGAAGG
TGCGGTCGTAGACGTCGGGCTCGTCCTGGGTCTCGGCGGCGATCGACTCGTCGGTGAGCAGATAGAGGTCGATGTGGGGC
CGCAACTCACGGATCCACTCGGCGCATTCCACCCAGTCGTGGGTCTCGTTTGCCACCGCTTCGTCGCCATCGGTGCCCAG
CAGCGTGGTCATCAGCGGCACCCGGTCGCGGGACCGCAGCGGCAGGTCGTGACGGATGATCGCCGCCTGAATCTCGCCAT
TCAGCGCCACCGCGGTGATGGCATCTTCGATGCTGGCCACCACGAGCAACTCGAACTGCACCTCGTCGGCCGGATTGCGC
AACTGCCGCAGGCACTCGGCCAAGCTGTCCGGAGCCGTCGCCGGGGAGTCGTCGGCGAGCAGCACGGTGTAGAACTGCTG
CTGTTTGGCCTGCGCTACCAGCTCCTGCTCCGCCAGTGACGCGGAGGTGTCGAACAGCGCTGTGCGGTCGCCGTATTCGG
ACAGCAGTCGTACGGCCAACGACACTTCCTCGGTAAGCCGCACCGTGGAATGACTATCCAGATGAGCGCGGAAAGTCGCC
AGATTCTGTGCCCCGGATACAGCCAGTACCGCTCATAGGCGCCGATGCGGTCCATCAGCCGCTTCGCCCGAGCCACGTC
GTGTGTGGTGTCGAGCCCGGCGAGGTCGACCTCCGCAGGTGACGACACGCGTCATCGAGCAGGTTCCAGGTGTCCAGGC
GGGTGTAGGACGGGTTGGCCACCGCGGCCAGCGCGGAGACATGCAGCCGTCGCGGGCGGACGCTGTTTGGGTTCATGTCG
TCACCTGTTCTCTGGTGCGGGTAGCGCCGTAGAGTGCAACCAGGCAATTATCGCGCGCAGGACCGGGTCAGTCAGCTAAG
TCGTCGCTGTCCGCGATCCGCCGATTAGCCCGATTCCCGGAGTTGTCCACCCAGCGCAGCACCGGCCAGCTGCGAAAGCTC
CCGGCGGCGTGCCGGCAGATCGGTGACGTCACCCAGCGAGCGCACCACGGCCTGCGTCAGGCCCATGATGGCGGCCATCA
CCGGTAGCAGCGGCTGCAACGGCTTTGCCGCCGTGCGAACAGTGCTGATGCGGCGTGCCAAGATCAGGCGTTCGATCGCG
TGATACAGCCAGGCGCCGACACCCAGCGCGTAGATCGACATTGCCGAGGCGACAATGGTCAGCCCGTAGGCGGCGCACAC
CACGGCACCGAGCACCACCGTCGCAGCCAGGACGGCCGCGACCACGACGCGCAGCTCGAGCCGGGTCATCACGCCCCCC
ACGCACCGCTTGAGCGGCCGCACGCAGCTGCGGGGTCACCAGCATGACCTGGCCCAGCACCCCGTTGACAAAGCCCGGCG
AGTCGTCGGTCGACAGCTCCTTGGCCAGCTGGACGGCCTCGTCGACGACCACCGGCTCCGGCACATCCGCCGCGTGGAGC
AGCTCCCATACCGAGACGCGCAGAATGGCGCGATCCACGGCGGGCAACCGGTCCAGCGTCCAGCCCCGCAGATGCGCGGT
GATCAGGTCGTCGATGTGGGCGGCGTGTTCACTGACCCCTCGAGCCACCGCGGCCGTGTACGGATGTAGCCGGGCAATGT
CGGGCTTCGCTTCGGCCAGCGCGGCACGGGTGTCGACCACCTCGGCCGCGCTGATGCCGCGGACCTCGGCCTCGAACAGC
AGGGCCACCGCGCGCTTACGGGCCTGATGTCGTCCGCGAACCGGCTTTCTGTCCGACATCGTCAGGCGTTGACCCGGCCC
AGGTAGCTACCGTCGCGCGAATCCACCTTTAGTTTGTCTCCGGTATTGATGAACAGCGGCACGTTGATCTGGGCTCCGGT
CTGAAGGGTGGCCGGCTTGGTGCCCGCGCTGGACCGGTCGCCCTGCAAGCCGGGCTCGGTGTGAGTGACCTCGAGCTCGA
CGGTCACCGGCAGCTCGATGTATAGCGGCACGCCGTTGTGGAACGCCACCTGCACCGGCATGCCCTCCAGCAGGAACCGT
GCCGCGTCCCCGACCAGGGCCTCCGGCAGCGGGTGCTGCTCGTAGTCTTGGCTGTCCATGAACACGAAGTCCGAGCCGTC
GCGGTAAAGGTAGGTGGTATCGCGCCGGTCGACGGTGGCGGTGTCCACCTTCACCCCGGCGTTGAACGTCTTGTCGACGA
CCTTGCCCGAGAGCACGTTCTTCAACTTGGTGCGCACGAACGCCGGACCCTTGCCCGGTTTGACGTGCTGGAACTCGGTG
ATTGTCCACAGCTGGCCGTCGATTACCAGGACCAGCCCGTTCTTGAAGTCAGCAGTGGTCGCCACGTGGGTCTCCTACAG
AATGGCCAGTTCTTTGGGGAACCGGGTCAACAATTCCGGGGTCTGCCCGGCGGTTTCAGGCATTTTCGGCGTCCCGCCAG
CCACTACCAATGTGTCCTCGATGCGGACACCGCCGCGGCCGGGTAAATAGACACCGGGCTCCACGGTCACCACGGAGCCC
GCCAGTAGTGTACCGGCGGATGTGACCCCGATGCCCGGCGCTTCATGTATCTGCAGGCCAACACCGTGTCCCAGTCCGTG
ACCGAAGTGCTCGCCGTAGCCGGCGTCGGCGATCAGCTGGCGCGCTGCAGCGTCCACCCCCGCAGCTCGGCACCCGGCA
GCAACGCCTGCCGACCGGCCTGTTGCGCCTCGGCCACCAGCTGATAGATCTCTAGCTGCCAGTCGGCGGCCTTGCCCAAC
ACGAAGGTGCGGGTCATATCGGAGTGGTACCCGGCGACCAGGGCGCCGAAGTCGATCTTCACGAAATCGCCGACCTGCAG
CACCGCGTCGGTCGGCCGGTGGTGCGGGATCGCCGAATTGGCCCCGGCAGCCACGATCGTCTCGAATGACACCGCGTCAG
CGCCATGATCGAGCATCAGGGCCTCCAGCTCGCGGCTCACCTGCCGTTCGGTTCGGCCCGGCCGCAGGCCGCCGCGGGCC
ACCAAGTCGGTCAGCGCGGCATCGGCTGCTTCGCAGGCTAGTCGCAGCAGCGCCAGCTCGCCGGCGTCTTTAACCTCGCG
CAGTGACTCCACAGTTCCGGATGCCCGCACCAACTCGGTGTTCTTGCCCTCCAGCGCGCCCGCCAAGGCGTCCAGGCCGT
CCACCGTGACCACCGTGGCTCTCGAAGCCCAGCTTTCCCACGCCGGCCTCGCCGGCCCGGCCGGCCAGGTAGCGCCCGACC
GCGCGCTCGATAGCCACTTCGAGGTCGGGCGCTTGCGAGGCGGCCTGAGTGCGGTACCGGCCGTCGGTGGCCAACACGGC
ATCGCGCTCATCGGCGAACACCAGCAATGCGCCGTTGGACCCGCTGAAGCCTGATAGATATCGCACGTTTATCAGGTCGC
TGATCAGCATCGCATCCAACCCGGAGGCAGCGATTTGTGCTTTCAGCTTGTCTCGACGCTGGGAATGTGTCACGACCCTT
GACGGTACTCGCTACGCTGAATGCCCATGACTAACTGGATGCTGCGCGGGTTGGCGTTCGCCGCCGCGATGGTGGTTCTC
CGCCTGTTCCAGGGGGCATTGATCAACGCGTGGCAGATGCTGTCCGGGCTGATCAGCCTGGTGCTACTGCTGCTCTTCGC
GATCGGAGGGGTGGTGTGGGGTGTGATGGACGGGCGCGCCGACGCCAAGGCGAGCCCTGACCCCGACCGCCGCCAAGACC
TGGCCATGACCTGGCTGTTGGCCGGCCTGGTAGCCGGCGCGCTCAGCGGCGCGGTGGCCTGGCTCATTTCGCTGTTCTAC
AAAGCGATCTACACCGGGGGCCCAATCAACGAGCTGACCACGTTCGCGGCCTTCACCGCGCTCATCGTCTTTCTGGTCGG
GATCGTCGGGGTAGCCGTGGGGCCGGTGCTGGTGGCCAGCTGGCGAAGGCACCGGTGCGACACCACGGGCTTGCCG
CTGAACACGAGCGGGCCGCCGACACCGATGTATTCTCCGCCGTTCGCGCCGACGACAGTCCGACCGGGGAGATGCAGGTC
GCGCAGCCTGAGGCACAAACCGCGGCCGTCGCCACGGTCGAACGTGAGGCACCCACCGAGGTGATCCGCACCACCGAAAG
CGATACACCCACCGAGGTTATCCGCACCGACACCGAGGCGGACCAGACCAAGCCCGGCGACGAGCCCAAGAAGGATTAAC
CCTCACGTCCCGACATGCTCAGCTAGGTACCGCAGGGCCAGCAGGTAGCCCTGGATGCCGAGCCCGACGATCACCCCGGT
CGCGATGGGGCTGAGGTAGGAGTGGCGGCGGAACTCCTCACGCGCATGCACGTTGGAGATATGCACCTCGATCAGCGGAG
```

FIGURE 6(continued)

```
CGCTCAGCTCCGCGCAGGCATCGCGCAGTGCCACCGACGTGTGCGTCAGACCGCCGGCGTTGAGGATCACGGGTTCGGCC
GCATCGGCGGCCTGATGAATCCAGTCCAGCAGCTGGGCTTCGCTATCACTTTGCCGCACAACGGCTTTGAGTCCGAGCTC
GGCGGCCTCACGCTCGATCAGAGCGACCAGCTCGTCGTGGGTGGTGCCGCCATAGACGGCGGGCTCGCGCCGGCCCAACC
GGCCCAGGTTGGGGCCGTTGATCACGTTCACGATCAGTTCGCTCATGGGGCGCAAACTCCGGCGTAGGCGGTTACCAGCA
GACCGGGGTCCGGTCCCACCATTCGGCCCGGCTTGGCCAATCCGTCGAGCACCACGAACCGCAACACACCCGCCCGAGTC
TTCTTGTCGCCGGCCATGATTTCCAGCAGCTGGGGCAGCGCGTCCGGGTCGTAGCTGACCGGCAATCCCAACGAGGACAG
GATGGTGCGGTGGCGCTGCGCGGTCGCGTCGTCGAGCCGCCCGGCAAGCCTGGCCAGCTCGGCCGCGAACACCAGCCCCA
CCGACACGGCGGCGCCGTGGCGCCACCGGTAGCGTTCCCGGCGCTCGATCGCGTGGCCTAATGTGTGGCCGTAGTTGAGG
ATTTCGCGCAGCTCGGATTCCTTTTCGTCGGCGGCGACCACCTCGGCCTTGACGGTGATCGCGCCGGATCAGCTCGGG
CAGCACGTCGCCGGCCGGGTCGAGTGCGGCCTGCGGGTCAGCTTCGATGAGATCCAGGATCACCGGGTCGGCGATGAAGC
CGGCCTTGACCACTTCGGCCATGCCGCAGATCATTTCGTCGCGTGGCAAGGTTTGCAGCGTCGCCAGGTCCACCAGGACC
GCCAACGGCTGATGAAACGCCCCGACCAGGTTCTTGCCGGCGTCGGTGTTGATGCCGGTCTTGCCGCCGACGGCCGCATC
GACCATGCCCAGCAGTGTGGTGGGCAGGTGCACAATCGAGACGCCGCGCAGCCAGGTGGCCGCCGCGAACCCGGCGACGT
CGGTGGCGGCCCCGCCGCCGAGGCTGACCAGGGCGTCTTTGCGGCCGATTCCGATGCGGCCCAACACCTCCCAGATGAAT
CCCACGACGGGCAGGTCCTTGCCGGCCTCGGCGTCGGGGATCTCGATGCGGTGCGCGTCGACGCCCTTGCCGGCCAAGCG
CTTTCGGATCTCTTCCGCGGTCTCGGCTAGTCCGGGCTGATGCACGACGGCGACCTTGTGCCGGTCGGCCAGCAGGTCTT
CCAGCTCGTCGAGCAGGCCGGTACCGATGACCACCGGGTATGGCGGATCGACGGCCACCTGCACGGTCACGGGTGCGCCG
ATATCGGTCATGTGGCCGCCTCGCTGGGGCTGGGAACCTGCAGCCGCGACAGGATATGGCGGACCACCGCCCCGGGGTTG
CGGCGATTGGTGTCCACTCGCATGGTCGCGACGCGCCGGTACAGCGGTGCCCGCTTGGCCATCAGCGCGCGGTATTTTTC
GGCGCGGTCGGGGCCGGCCAGCAGTGGGCGCACGGTGTTGCCGCCGGTGCGGCGCACGCCCTCGGCGGCGCTGATCTCCA
GGTAGACGACGGTGTGGCCGGCCAGCGCCGCGCGCACACCGGGGCTGGTCACCGCGCCGCCGCCGAGCGACAGCACACCG
TCGTGGTCGGCCAGTGCCGCGCGCACCACGTCCTCCTCGATACGTCGGAACTCCTGCTCCCCGTCGGTGGCGAAGATGTC
GGCGATGCTGCGTCCGGTCCGCTGCTCGATCGCGACGTCGGTGTCGAGCAGGCCGACCCCGAGCGCCTTGGCCAGCCGGC
GCCCGATGGTGGACTTGCCGGAGCCCGGCAGGCCGACGAGAACCGCTTTGGGTGCCATCTGTTAACCGGAGACCCGCGCG
GCCGGTGCTTCGCGGTCGGCGACGCTGCGCTGGTAGGCGGCGATGTTGCGCTGGGTTTCGGCCAGCGAATCCCCGCCGAA
TTTTTCCAGCGCCGCCCGGGCCAGCACCAACGCCACCATGGTCTCCACCACGACCCCGGCCGCCGGCACCGCGCACACAT
CCGAGCGCTGATGGATGGCGACGGCCTCATCGCCGGTCGCCAGGTCGACGGTGGCCAGCGCGCGCGGCACCGTGGAGATC
GGCTTCATCGCCGCACGCACCCGCAGCGGCTGCCCGTTGGTCATCCCGCCTTCCAGCCCCCCGGCCCGGTTGGTGGAGCG
GACGACGCCGTCGGGCCCGGGGTACATCTCGTCGTGGCGCGGCTGCCGCGGCGGCCGCGGGTCGGCCGGTCTGGAATCCGTCGCCGA
TCTCCACGCCCTTGATCGCCTGGATGCCCATGACGGCGGCGGCCAGCTGGCTGTCGAGCCGATGGTCGCCGCTGGTGAAC
GACCCCAGCCCCACCGGCAGGCCCAGCGCGACCGCCTCCACCACGCCGCCGAGGGTGTCGCCGTCTTTCTTGGCCGCCTC
GATTTGGGCGATCATGTCCGCCTCGGCGGCCTTGTCGTAGGCGCGTACCGGGCTGGCGTCGATGGCGGGTAGGTCCTCGG
CCCGCGGCGGCGGACCCTCGTAGGGTGCCGACGCGCCGATCGAGATGACGTGGGAGAGCACCTCGACACCCAGCGCCTGC
CTCAGGAATGCCCGTGCGACCGTGCCCGCCGCGACCCGGGCGGCGGTCTCGCGGGCGCTGGCCCGCTCCAGCACCGGCCG
CGCGTCGTCGAAGCCGTATTTGAGCATGCCCGCGTAGTCGGCGTGGCCCGGCCGCGGGTGAGCGGGGCGTTGCGTG
CGACGTCGGCCAGCTCGGCGGGGTCGACCGGGTCGGCGGCCATCACGGTCTCCCATTTGGGCCATTCGGTGTTGCCGATC
TCGATGGCGATGGGCCCGCCCAGGGTGCTGCCGTGGCGTATCCCGGACAGCACGGTCACCGCGTCGCGCTCAACGTCAT
CCGTGCGCCGCGGCCGTAGCCCAGCCGGCGTCGGGCCAGCTGGTCGGCGATGTCGGCCGAGGTGACGTGCACGCCGGCGA
CCATGCCTTCGACCACGGCCACCAAGGCGCGCGGCCGTGTGACTCCCCCGCGGTGATCCAGCGCAACACCTGACCATCTTCC
CATGCGCCGCCGGCGGCCACCGCACGTCAACGCACCCACTCCGTGCGATCGCGGTGATGTGCGGCCCCCCGGATGCCCCG
CTAGCATCCCTGGCGTGGAAGTGGCTGGCGGCACCCGGGCCCGGCTGCGGGTCACAGCCGATGGTTTGCAGGCGCTGGCC
GGGCGGTGCGCGACCCTGGCCGGCGAATTGTCGCGGTCGCGCCGTCGGGGGCGGTGTTGTCGTGGCAGGCCAACGC
GGTCGCGGTGAACGCCGCGCATGCCCGCGCGGGTGCGGCCGCCGCGGCTGTGAGCGCCCGAATGCGGGCCACCGCCGCCG
CGCTGGGCAGGCCGCCCGCCGGTACGCGGGCCAGGACACCGCAGCGGCGGCCGCCCTGGGGGCGGTACGCCCGTGGGGG
ACCCACTGATGGCTACGTCGGGGCTGCCGCCGCTGTCGGCGGTGCAGTCGACGAGCTTTGCGCATCTGAGCGAGGCCGCC
GCCCACTGGCGGCGGCTGGCCACGCGGTGGGAGCGCGCCTTAGCCGAGGTGCGCGATTCGATGCGCCGACCCGGCGGCAC
CGACTGGGAGGGCCAGGCCGCGGCCCGCGCCCACTACCGGTCGACCGTCGACGTGGTGACGATCGGTCGCGCGGTGGACC
GGCTGCATGACGCCGCCGCCGTCGCCGGCCGGGGGAAGACCAGCTGGAGGCCAACCGGCGGGCGGTGCTGGACGCTGTCA
GCGACGCCCGCCGGGACGGGTTTGCCGTCGGTGAGGATTACACGGTCACCGACCGCTCCACGGGTGGCTCACGCCAGCAG
CGGGCGGCGCGTCTGGGCCAAGCCCAGGGGCACGCCGACTTTATCCGGCATCGGGTGGGCGCGCTGCTGGCCACCGACCG
CGATATCGCGACCCGGGTCAGCGCCGCCACCCAAGGCCTCGATGAGCTGGCGTTCGAAGACGTGCCCGGGGTCGACACCC
CGGCCGAGGATGGGGTGCAGGCGGTGGATTTCCGCCAGGCCCCGCCACCGGGAGCCCCCGGGGGCATGTCCTCCGGCGAC
ATCGACGCGATCGACGCGGCCAATCGCGCCCTGCTGCAAGACATGCTGGCGGAGTACAGCCGGCTGCCCGACGGGCAGGT
GAAAACCGACCGGCTGGCCGACATCGCGGCCATCCAAGAGGCGCTGAGGGTGCCCGACTCGCATTTGATCTATGTGGCCA
GGCCGGACGACCCCGCCGACATGATCCCGGCGGTCACCGCGGTCGGCGATCCGTTCACCGCCGATCACGTGTCGGTGACG
GTCCCCGGGGTGTCGGGAACCACCCGTCAGACCATCGCCACCATGACCCAAGAAACCCGTGGGCTACGAGAAGAAGCGAG
```

FIGURE 6(continued)

```
AGTGATCGCCCACAGCGTGGGTGAAAGTGAGAATGTGGCGACCATAGCGTGGGTGGGGTATCAGCCGCCGCCGGTGCTCG
CGTCGTGGAACACCGTTGATGACGATCTCGCGCAGGCCGGCGCTCCGAAGTTGGAGGCGTTTTTGCGGGATCTGCAGGCG
GGATCGCACAATCCGGGTCACACGACGGCGTTGTTCGGGCATTCCTACGGGTCGTTGCTGTCGGGGATCGCGTTGAAGGA
TGGCGCCAGTTCACTGGTCGACAATGCGGTGCTGTATGGCTCGCCGGGGTTTGACGCGACCTCACCGGCCAAGCTGGGCA
TGAACGACCACAACTTCTTCGTGATGACCACACCCGATGACCCCATCCGGTATCCGGCGCGCCTGGCACCCCTGCACGGG
TGGGGATCAGACGGCGCCGACACCATCGGCACTGTAGGCCGCCAAGGCACCCCTGCACGGGTGGGGATCAGACCCCAACG
AGATCATCGCCGGATCCCCGGACCGCTACCGCTTCACCCATCTGCAGACCGACGCGGGATCCACTCCGCTGGGTGATCAC
AAGACCGCCGCCAGCGGGCACTCGCAATACGGCCAAGACCCGCTGCAACGGATGACCGGCTACAACCTGGCGACCATCCT
GCTCAACCGGCCCGATCTGGCGGTGCGCGAAAGCCCACAGCAGTGATCGCACCACAACCGATTTCCCGAACGCTCCCGCG
GTGGCAGCGCATCGTCGCGCTGACCATGATCGGCATATCAACCGCCCTGATAGGTGGCTGCACCATGGATCACAACCCTG
ACACATCACGGCGCCTGACCGGCGAGCAGAAGATCCAGCTCATCGACAGCATGCGCAACAAGGGCTCCTACGAGGCCGCC
CGGGAGCGCCTAACCGCCACCGCCCGGATCATCGCCGACCGCGTCAGTGCGGCCATCCCGGGCCAAACCTGGAAATTCGA
CGACGATCCCAACATACAACAGTCTGACCGAAACGGAGCACTGTGCGACAAGCTCACCGCGGATATCGCGCGGCGGCCGA
TCGCCAACAGCGTAATGTTCGGCGCCACGTTCTCGGCCGAGGACTTCAAGATTGCCGCCAATATCGTGCGGGAGGAAGCC
GCCAAGTACGGTGCGACCACCGAGTCGTCGCTATTTAACGAATCGGCCAAGCGCGACTACGACGTGCAGGGCAACGGCTA
CGAATTCCGACTCCTGCAAATCAAATTCGCCACACTTAACATCACCGGCGATTGTTTTCTGTTGCAGAAGGTGCTCGACC
TGCCGGCCGGACAACTCCCCCCGGAACCACCCATCTGGCCAACGACCTCGACGCCACATTGATCGCACCACAACCGATTC
CCCGAACGCTCCCACGGTGGCAGCGCATCGTCGCGCTGACCATGATCGGCATATCAACCGCCCTGATAGGTGGCTGCACA
ATGGGCCAAAACCCCGACAAATCACCGCACCTGACCGGCGAGCAGAAGATCCAGCTCATCGACAGCATGCGCCACAAAGG
CTCCTACGAGGCCGCCCGGGAACGCCTCACCGCCACCGCCCAGATCATCGCCGACCGCGTCAGTGCGGCCATCCCGGGCC
AAACCTGGAAATTCAACGACGACTCCTACGGCCAAGACTTCTATAGAAATGGATCGTTGTGTAAGGAACTCAGTGCCGAT
ATCGCCCGGCGGCCGATGGCCAAACCGGTTGACTTCGGTAGCACATTCTCGGCGGAAGACTTCAAGATTGCCGCCAATAT
CGTGCGAGAGGAAGCCGCCAAGTACGGTGTGACCACCGAGTCGTCGCTGTTTAACGAATCGGCCAAACGCGACTACGACG
TGCAGGGCAACGGCTACGAATTCAACCTGGGCCAAATCAAATTCGCCACACTTAACATCACCGGCGACTGTTTTCTGTTG
CAGAAGGTGCTCGACCTGCCGGCCGGACAACTCCCCCCCGAACCACCCATTTGGCCGACGACCTCGACGCCAACCCCGTG
AGCACCACCATCGTTGCTGGCGTGATCCAGGGTCACCTGCCGGTGATCCTGCCCACGCGCAGGCGGGCTCGCGATCTCGG
GCACACGACGGCGTTATTTCGGGCGCAAACGCTCCAATGCATATATCTCAGTATCGAATACCTATATGTTTGCTCCATGT
CTCGGCGTACAACGATCGACATCGATGACATACTGCTGGCCCGCGCGCAAGCGGCGCTCGGTACCACCGGGCTGAAGGAC
AGGGTCGATGCCGCTTTGCGAGCGCGCGGTGCGCTAGTCGGCGCGCACTCGGCTCGCCGCGCGAATCGCCTCGGGTGCCGG
CATCGATCGGTCCGAGGCGCTGCTTGCCCAGACGCGTCCCGCGCGGTGATGGTGTTCTGCGTCGACACCAGCGCGTGGCA
TCACGCGGCGCGGCCGGAAGTTGCGCGCCGATGGTTGGCGGCCTTGTCCGCGGACCAGATCGGCATCTGCGACCACGTGC
GGTTGGAGATCCTGTACTCGGCGAACTCCGCTACCGACTACGACGCGCTCGCCGACGAACTCGACGGCTTGGCCCGTATA
CCAGTCGGTGCCGAAACCTTTACGCGCGCATGCCAAGTCCAGCGTGAGCTTGCCCACGTCGCCGGTCTGCATCACCGCAG
CGTGAAGATCGCCGATCTTGTCATCGCCGCGGCGGCCGAACTTTCAGGCACCATCGTGTGGCATTACGACGAGAACTATG
ACCGGGTCGCCGCCATCACCGGCCAACCTACGGAGTGGATCGTGCCGCGCGGGACCCTTTAACCGCTGATAGGCGCCATC
ACTGGATGTATGGTGATGTCATGCGGACTCAGGTGACCCTGGGCAAAGAGGAGCTTGAGCTGCTCGATCGTGCCGCCAAG
GCGAGTGGCGCATCGCGGTCCGAACTCATCCGACGCGCAATTCACCGTGCCTACGGGACTGGATCCAAGCAGGAACGGCT
CGCCGCGCTCGACCACAGCCGTGGCTCGTGGCGAGGACGGGACTTCACCGGCACCGAGTATGTCGACGCCATTCGGGGCG
ACCTCAACGAACGACTTGCTCGGCTCGGTCTGGCGTGAAGCTGATCGACACCACCATCGCGGTCGACCACCTTCGCGGCG
AACCCGCGGCAGCCGTGCTGCTCGCCGAACTGATAAACAACGGTGAGGAGATCGCGGCCAGCGAGCTGGTCCGATTCGAA
CTCCTCGCCGGTGTGCGGGAAAGCGAACTCGCGGCGCTCGAGGCCGTTCTTCTCGGCAGTGGTGTGGACCCTGGTGACCGA
GGACATTGCCCGGATCGGCGGACGACTCGCCCGTCGATACCGGTCCAGCCACCGCGGTATCGACGACGTGGACTACCTGA
TCGCTGCGACCGCCATTGTGGTCGACGCCGACCTGCTCACCACCAATGTGCCGCACTTCCCGATGTTCCCGGATCTGCAG
CCGCCGTACTGAGCACTCCCTGGGGCATCAGCCTTGGTCGGCGATGAGTTGTTCGATGAGCTCGACGATGCGCTGTTGGC
CGGCGGCGGCCCCGTCCAGCTTGCCTCGCATCTCGGTGAATCCGTCGTCGACTCGACTAAAACGTTCTTCTACGTGACTG
AAACGTTCGGTCATCTCTTCCCGCAGGGCGGTGAAATCTTCTCGCAGGGCGTTGAAGCTACCGATTGTAGCTCGCCGGAA
GTCGCGGAACTCGCCAACGAACTCCGTGACATCGCGATCGGCCGCGCCGGCTAGCACGCGAGCGGCGGCATCCTGTT
CGCTGGCCCGCACGCGGTCAGCCAGCTCACGCACTTGGGATTCCAGCGCGGTGACCCGTTGTTCGAGGTTCTCGGGCAGC
ACGAGCGAATCCTACCGCGATTCAACGCAACGCAGCCCTGTCCCGGGCGGACACCGGCATTGGGTGCACGTCGGATAAGC
AGGGCTGAGCGGGGCTCGGCTCTACTCGGGTCTTACCTCGACAAATCCGGCCGCGCTGAAGTCACCATCGAAGGCATACG
CATTTTGGATGCCTTTCTTTCGCATCACCGCGAAGCTCGTGGCATCGACGAACGAGTACTCTCGCTCGTCGTGGCGTACA
AGCCATTCCCATGCCTGCTCTTCCAGGTCGGCTGTTACGTGCTCGACGCGAACGACGGTGCTCAAGCGGATTGCAGCGGC
GGCAACCGCCGCGGTGACCGCAGCGCCGGTTGAGCAGCGTCCAGGTCTCGCCCAGGACATGGTTGGAGGTCATCACCA
CGGGCGGTTTGCTGGCCCACAACCTCTTCGCGGTGCCCGTCGCCGAGCGTCGCCGGCGTTGCCAAGTGCAGCCCAGAAGGAC
GTGTCGACGAAGATCATTCGTGCTTTCCGTAAACCACGTCGTCGACGGACGCGGACAAGTCGGCTTCCCCCACGAACGAT
CCGACGAAGGCATCGACCGGATCTGGGCCCGGCTGCCGGAGGTGCTCAGCGACGTACTCCCGGATCAGCGCCGCCTTCGA
```

FIGURE 6(continued)

```
CGTCCGCCGCCGTCGCGCTTCAACAGCAAGCGCTCGGTCAACGTCTTCGTCGATGTAGATCTGCAGCCTTTTCACATGGC
AAATATACGCCACTAGCATAATGCTGTATACATCGGTAGCCGAGAATCGGATGCTTGCCGCTGGCTGCCGAGTTTGTTGA
ACTCGCCGCCGTGGTGACCTGGATGAAGTGTGCCCGCCGAAACTGCCGCCGCCCGACTAGGCGACTGGCCAAAGCGATGA
CAGTGCTGACTTCTGTACAGGGGCGAAGCGAGTGTCCGCCCCTTTACGCGCGTCGTAATCAGCCGCTGAGTTCGCCATGG
TTCCCATGCAAGATCGCTCACGTTCGAGCCCGGCGCGCGGTGACCGACATGAAACTCCCGTTACGAGCAAGCATGCGGCA
ACGCCGCCTCGACGGCGACGGTCCAAGCTGTCCTCTGAACGAATCAGGTTGCGCTAAGCCAAGATTCGTTGTCAAACGAC
CTCTGGTCTACACTGATATCGCGCCAATCTCAGCCCAGCAGCGCCAACCCCACCGCCCCAGGCTGGCCACACACATCGA
CGGCCCGTGCGGCAGGGTGCGGACACCCCATGGCGTCACCATCACGCCGCACACCGCGGTCAGCAGCGGCGCGGCCAGCG
CCGCCAGAAACCACACCTCGACCCCGAAGCAGCCGGTCAGCCCGCCCAGACCGATCGCCAGCTTGACGTCACCGGCGCCC
ATCGCGGCGGGCAAAGCCAGGTGCACCAGCAGGTACACCCCGGCCAAGGCGGCCGCCCCGGCCAGCGCCGGCACACCGCG
GCCGGCAAGGCCCGCGAAGAGCAGGATCACCCCCGCCCGGGCAGGGTGAGCCAGTTGGGTAGCCGGCGCTGCCGGACGT
CGCAAACGCACAACACTCCCATCCAGGCCAACACCGCCGCCGCCAGCATGCTGGGGCACGCTAGTCCAACGCGGCCAGCG
CGCAAGTCATCGCTTCGCGGGGGCGGGTAGCCCGGTGAACTGCTCCACCTGCGCGAACGCCTGATGCAGCAACATCTGC
AGCCCGCTGATCACCCGCCCGCCCGCCGATCCGACCGCGGCGGCCAGCGGTGTGGGCCACGGATCGTAGATGGCGTCCAA
CAGCACCGGGATCGCGGCCAAGGTGCCGGCATACCCCGCGGCCACCTCCGCTGGAATGGTGCTGACCAGCACTTCCGCGG
CGGCCACCGCATCGGCCAACCCACCGCTGTCGAACGCGCAGAACCGGGTCGCCACGCCGACCCGTGTGCCCAGGTCCACC
AGCCGGGCCGCCTTGTCCGAGTTGCGCGCCACCACGGTGATGTCGGTGACCCCGAGTTCGGCCAGCCCCACCACGGCCGC
CGGTGCGGTCCCCCGGACCCCAGCACCAGCGCGTGTCCAGCAGCCGCCCCAACGCCCGGCCACCCCGTCGATGTCGG
TGTTGTCGGCCCGCCAGCCATGCGGCGTCCGAACCAGGGTGTTGGCCGAACCGACAAGGTCCGCGCGTGCGGTGCGCTCG
TCGGCGAACCGCAGGGCGGCGAACTTGCCCGGCATGGTCACCGAAACACCGACCCACTCCGGTCCGAAACCACCGACCAC
GACGGGCAACTCGGCCGCACCGCATTCGATGCGCTCATAGGTCCAGTCGTGCAGCCCCAACGCCCGGTAGGCGGCCAGGT
GCAGCTGCGGGGAGCGGGAATCGCGATCGGCGAACCAAGCACGCCGGCTTTTTGGGACCTTCGCTCATCGCGCGCTGT
CGAGGACACCGTTGTGTTTGGCCAGCTCGATGTTCGCCAGATGCTGCTGATAGTCCCTGGTGAACAGCGTCGTGCCCTGG
GAATCGATGGTGACGAAGTACAGCCAGTCGCCAGGTACTGGATGCTCGGCGGCGCGCAGCGCGTCGACGCCGGCGAACA
GATCGCGGTGGCCGGCAGCCCCTGGGCCATGTAGGTGTTCCACGGTGTGCGCTGGGCACGGTCGGTGTCGCTGGTGGCCA
CCTCACGGCGATCCAGCGGATAGTTCACGGTCGAGTCGAACTCCAACGTGCGGTGTTCGTGCAGCCGGTTGTAGATGACC
CGGGCCACCTTCGGGAAATCCTGGGTGTTGGCTTCCTGCTGCACCAGCGAGGCCACCACGAGAATGTCATAGGGCGACAG
GCCCAGCGACTTTGCGGTGTTCTACCAACCCGGATTTCATGTACTCCACGGCGCCGGCGCTGATCAAGGTCGCCAAGATGG
TTTCAGCCGATGCCGACGGGTCGATGTTGAAGGTCCCCGGTGCGATCAGCCCCTCGATCCGGCGATGGTCAGTGCCCAGC
TCCATCACCGGCCCAACCGCCCAGCGCGGCACTGACAGCATCGTCGGCGTGCTCCTGCTCGCCGCCGCGCGGAGGTCGGC
CACCGAGACGCAGCGTTGGGTACCGTCGAGATCCACACAGGTGGCACGGGAGATCAGCGCGAATATGCCAGGATTCACCA
CGTTGGTCTTCATGTCGGTGGTGTCGTCGAGCTGACGCCCTTCCGGTATGACCAACTTCCCCACCCGGTTGTGCGGATCG
GTAAGCCGCGCGACAGCCGAAGCCGCCGAAATCTCGGTTCGCATCCGATAGAACCCGGGTTGGATCGAGGAAATCGCGGT
GTTGCCGTGCGCGGCATCGACGAATGCTCGGACGGTGGCCACTACACCGTGTTTGAGCAGCGTCTCCCCGACCGCCGTGG
TCGAGTCACCGGCCCTGATCTGAATCACGATGTCTCGCTTGCCGGGACCGGTGTAGTCGTTACCGAAGCCCAACATGGTC
TGCCACAACTTGGCGCCGACGACGACGGCCACCACCACCACCACGACGAGCAGGCTCAGGGCAAATCCGCCGGCGACGCG
CCGTCGCCGGCGGATTTGTTGGGCGTGTCGGCGCTGAGCGCGGCTGACTCGGGTCCTGCGGTGCCGGTTCGGTCTTACCG
ACACCGCTGGGCGCGGTGGCGGTGGCCACCGTCAGGCATCGGAGCCTTCTTGAGTCCCGGCCATCGCCGCGAGACGTTC
ATCCAGCCAGCTCTGCAGTATTGCCACTGCGGCCGCTTGGTCGATCACCGCACGCTGCTCGGAGGCCCGCACCCCCGCCT
GCCGCAAAGATCGTTGAGCACTGACCGTGGTGAGCCGCTCGTCGGCCAGCCGCCACCGGCGTAGGAGAAACACGGCGTGCC
AGCGCCTCGGCCAGTTCGATTGCGTCTTGGGCCGAGCGGCCGATGCGGTCGGCCAGCGTGCGCGGGAGCCCGACGATCAC
CTCGACCGCCTCCAACTCGGCGGCCAGCGCAGCCAGCCTGCGCAGGTGCTTGCCGGAACGATCGCGGCGCACCGTTTCCA
CCGGGGTGGCCAAGATCGCGTCCGGGTCGCTGCAAGCCACGCCGATACGCGCGGCGCCCACGTCGATACCGAGGCGTCGT
CCCCGTCCAGGGTCGTGCGCTGGATCGCCGGGCCGGTCGGGCGGGCGGTGCTGTGCTGGGACCACTCAACCGACCCGCGC
TATCACGGCGATCTCGGAGCGGACCGCCGTCGAGCGCGGCGTCGATACCGGTCGGATTCTTTCCCGAGCCCTGCGCCAGGT
CCGCCTTACCGCCACCGCGGCCTTCGCCGCCACCGCAAGTTGTTTGACCAGGTCGTTGGCACGGATTCCGAGGTCCTGG
GCAGCGGGATTGGCCGCGACCGCATACGGCACAGTTTGGCTTTCGCCCTCGCAATCAGCGCCACCACCGCCGGCTCGCT
ACCCAGCTTGCCGCGGATGTCGCCGATCAACGACCGCAGGTCTGCCGCGGTCATCCCGCCGGACATTCGCTGCGCCACCA
AACGGACGTTACCGATCCGCTGAGCCCCGGCGGCGGCATTGGTGGCGGCTGCCCGGGCGCTGGCCATCCGGACACGTTCG
AGTTCCTTCTCGGCGGCCCGCAGGCGCTCCACTAGATTGGCCACCCGGGCCGGTACCTCTTCGGACGGCACCTTCAGTGA
CGAGGCCAACCCGGCCATCAACGCACGCTCCTTGGCCAGGTGACGAAACGAATCCAACCCCACGTAGGCCTCCACCCGGC
GCACCCCGGAGCCGATCGACGACTCGCCCAGGATCGTCACGGGACCGATCTGCGCCGTGTTGCTCACATGGGTGCCGCCA
CATAGCTCCAGCGAGAACGGTCCACCCATCTCCACCACCCGCTTCGTCGGGGTAGCTCTCGCCGAACAGCGCGATGGC
ACCCATCGCCTTGGCCTTGTCGAGCTGTTCGGTGAACGTGCGCACCTCGAAGTCCGCTTGCACGGCCTCGTTGGTGACCT
CTTCGACCTGGGTGCGCTGGTCGTCGGTCAACGGACCCTGCCAGTTAAAGTCGAAGCGCAAATATCCCGGCCGGTTCAGC
GATCCCGCCTGAACCGCGTTGGGCCCCAGCACTTGTCGCAGCGCGGCATGCACCATGTGGGTGCCCGAGTGGCCCTGCGT
```

FIGURE 6(continued)

```
GGCACCCCGGCGCCACCCGGGATCCACCGCCGCGATTACGGTGTCACCCTCGACGAATTCCCCGGATTCCACGTTGACTC
GGTGCACCCAAAGCGTTTTGGCGATCTTCTGCACGTCGGTAACCGCGGCCCGGGCAGCTTCGCTGGAACCGGTTCCGCTG
ATGGTGCCCTCATCGGCGATCTGCCCACCCGATTCGGCGTAGAGCGGGGTGCGATCTAAGACAAGTTCGACACGCTGCCC
TTCCCCGGCTCCGCCGGCTACACCGTGCGCCACCACCGGAACCCGCTTACCGTCGACGAAGATGCCCAGAATCCGCGCCT
GGGAACGCAACTCGTCGAATCCGGTGAACTCGGTGGCGCCGGCGTCAACCAGCTCGCGGTAGGCGCTCAGGTCAGCATGC
GCGTGTTTGCGCGCGGCGGCGTCGGCCTTGGCACGGCGGCGCTGCTCGGCCATCAGCTCACGGAACCCGATTTCGTCTAC
CTGCAGACCGGTTTCGGCCGCCATCTCCAGCGTGAGCTCGATCGGGAACCCGTAGGTGTCATGCAACGTGAAAGCGTCCG
ATCCGGACAGCACGGTGGCTCCGGATTTCTTGGTGGAGCTAGCCACCTCCTCGAACAGCCTGGAACCCGACGCCAGCGTG
CGGTTGAACGCCGTCTCCTCGGCGACCGCGATCCGGCTGATCCGCTCGAAGTCGGCGACGAGTTCGGGATATGACGGGCC
CATCGCGTTGCGCACCGTGGCCATCAGGTCGCCAACGATCGCAGCGTCGATGCCCAGCAGCTTGGCGGAGCGGATCACCC
GACGCAGCAGCCGGCGCAGCACATAACCGCGACCGTCGTTGCCGGGGCTGACGCCGTCACCGATCAGGATCGCGGCGGTG
CGGCTGTGGTCTGCGATGATGCGGTACCGCACGTCGTCTTCGTGGTTGCCGACGTCGTAGGCACGCGCGGCGACCCTGGC
CACGGTATCGATGACCGGCCTGAGCAGGTCCGTCTCGTAGACGTTGTGCACGTCTTGCAGCACCAGCGCGATCCGCTCGA
CGCCCATGCCGGTGTCGATGTTCTTGCGGGGCAGCGGCCCGAGGATCTGGTAGTCCTCCTTGGTGGTTCCCTCTCCGCGC
TCGTTCTGCATGAACACCAGGTTCCAGACCTCGAGGTAGCGGTCTTCGCTGACGATGGGACCGCCTGCGGGACCGAATTC
GGGTCCGCGGTCGTAATAGATCTCCGATGACGGCCCGCACGGTCCGGGAATGCCCATCGACCAGTAGTTGTCGGCCATGC
CGCGGCGCTGGATTCGCTCCGCCGGCAGCCCGGCAACCTCCTGCCATAGCCGGACAGCTTCGTCGTCGTCGAAATAGACT
GTCGTCCAGATTCTTTCCGGGTCCAGGCCGTAGCCGCCGGCGGCGAGGCTGTTGGTCAGCAGTGCCCAGGCCAGTTCAAT
GGCCCCGCGTTTGAAATAGTCGCCGAAGCTGAAATTGCCGGCCATCTGAAAAAACGTGTTGTGCCGGGTGGTTATGCCCA
CCTCGTCGATATCGGGGTACGGATGCACTTCTGGATGCTGGTGGCCGTCGGGTACGGCGGCGTGCGCTGTCCCAAGAAG
AAAGGCACGAACTGGACCATCCCCGGCGTTGACGAACAACAGGTTGGGGTCGTCGAGGATCACCGAGGCGCTGGGCACCTC
GGTGTGGCCCGCCTTCACGAAATGATCGAGGAACCGCTTCCTGATCTCGTGTGTCTGCACTCTACGTTCTTCCTTGATCC
GTGGTTAAGTCCATTACCAGCCTATTCGCCGGATTATGAGAAGGCTGTCCGACGGCCCAATTCGGCCCGCTCAGCGTTCC
ACAAAGCTCAATCGCACCGACCGCCGCGGATTGTCCTGGTTGAGGTCGACCAGAACGATGCTTTGCCAGGTGCCCAGCAG
GGGCTGGCCCCCGAGACCGGCACCGTCACCGACGGCGCAACAAAAGCCGGTAACAAGTGGTCGGCGCCGTGACCGTAGG
ACCCGTGCGCGTGCCGGTAGCGGTCGTCGCGCGGCAACAACCGCACCAGCGTGTCCACCAGATCCTCGTCGGAACCGGCG
CCGGTCTCGATAATCGCAACGCCGGCCGTAGCGTGCGGGACGAACACGTTGCACAGGCCATCATCATGGGCGGTGCAGAA
GGCGCGCACGGCGTCGGTGAGATCGACAATGCCGCGACGCCGGTGTCCACATCCAGCACATCGGTATCCACCCGTCCCA
GCCTACGGTGGGGGCGCGCCAACCTGCCAATCCATTGACGTCGGATTGCCCATTGCCCCGGCCGGCCCGTCGGAGGAAGG
TAATGATTGACCGGTGGCGCCACCGGGGCGCTGCCCCGAACAATGAAAGAGGGGTGGATCGTGTACGCGCGCTCTACCAC
TATTCAGGCGCAATCCGAGTGCATCGACACCGGAATTGCGCACGTTCGCGATGTGGTTATGCCCGCACTGCAGGGGATGG
ATGGGTGCATCGGCGTATCCCTTTTGGTCGACCGGCAATCCGGCAGGTGCATCGCCACCAGTGCCTGGGAGACCGCGGAA
GCCATGCATGCAAGCCGGGAACAGGTAACGCCGATCCGCGATCGGTGCGCGGAGATGTTCGGCGGCACGCCGGCCGTCGA
GGAGTGGGAGATCGCGGCGATGCATCGCGACCACCGCTCGACACGGGACGGGGGCGTGTGTGCGGGCGACCTGGGTCAAGGTGC
CGGCGGACCAAGTAGATCAAGGCATCGAGTACTACAAGTCGTCCGTCCTGCCCCAAATCGAAGGCCTCGACGGATTCTGC
AGCGCCAGCCTGTTGGTCGACCGCACCTCCGGGCGCGCGGTGTCTTCCGCGACCTTCGACAGCTTTGACGCCATGGAGCG
CAACCGGACCAGTCGAATGCGCTCAAGGCCACATCGCTGCGTGAGGCGGGCGGCGAGGAACTCGATGAATGCGAGTTCG
AGCTGGCGCTAGCGCACCTACGGGTACCCGAGCTGGTCTGATCAACCCGCCGGCGGCAGTACCGGCCCGAGCCCGACGCT
GGGCCGGCACTGCTGTCGTCGTCGAGCGGCGCTCGCGGTAGGCATTGCCAGGCTCAGCCGGTTGGAGGAAGGTATTTGG
TGGGACCGGTGGCGCCACCGGGGCGCTGCCCCGACACGGGAGGGGGTCGATCGTGTACGCACGCTCAACCACCATTGAGG
CGCAACCTCTGTCGGTCGACATTGGAATCGCGCATGTTCGTGACGTCGTCATGCCCGCTTTGCAGGAGATCGACGGGTGT
GTCGGGGTGTCGCTGTTGGTCGACCGGCAATCCGGCCGGTGCATCGCCACCAGCGCCTGGGAGACCTTGGAGGCGATGCG
CGCCAGCGTCGAGCGGGTGGCACCCATCCGCGACCGCGCCGCGCTGATGTTCGCCGGTAGTGCCCGGGTCGAGGAATGGG
ACATCGCCCTGTTGCACCGCGACCACCCGTCGCATGAGGGGGCATGCGTGCGCGCCACCTGGCTCAAAGTGGTGCCAGAC
CAGCTCGGTCGGTCCCTGGAGTTCTACCGCACGTCCGTACTTCCCGAGCTGGAGAGTCTGGACGGGTTCTGCAGCGCCAG
CCTGATGGTCGACCACCCCGCTTGCCGGCGTGCGGTGTCGTGCTCGACGTTCGACAGCATGGACGCGATGGCCCGCAACC
GCGACCGGCGAGCGAGCTGCGCAGCAGGCGCGTCCGGGAATTGGGAGCCGAGGTCCTCGACGTCGCCGAATTCGAACTG
GCGATCGCACATCTACGGGTACCCGAGCTGGTCTGAGCGGACCTGCTTCCCGCAGAGCGCAGCGGTCACCCCCGTTTCTT
GCGGATGATTGCCCGCAGGCGGTCCAGGCGGCCGGCGATCTCGCGTTCGCCGCCGCGACCAGTGGGCCGGTAGTAGTCCA
CGTCCACCAACTCGTCGGGCGGGTATTGCTGGGCCACAACGCCATCCGGGTCGTCATGGGAATATTTGTAGCCCTGTGCA
TTGCCCAGCGCCGCCGCCCCGGAGTAATGCCCGTCACGCAGATGAGCCGGCACCAGACCGGCCTTGCCGGCCTTGATGTC
GTTCATCGCCGCGGCCAACGCCGTGGTGACGGCGTTTGACTTCGGTGCGGTGGCCAGGTGGATGGTGGCGTGCGCCAGCG
TCAGCTGGGCTTCGGGCATGCCGATCAGCGCCACCGTCTGTGCGGCGGCGACCGCCACCTGCAGCGCGCTCGGGCCGGCC
ATGCCGATGTCCTCGCTGGCCAGAATCATCAGCCGGCGGGCGATGAACCGCGGGTCCTCCCCGGCGACCAGCATGCGGGC
CAAATAGTGCAGCGCGGCATCGACGTCGGAACCGCGCACCGATTTGATGAAGGCGCTGACGACGTCGTAGTGCTGGTCGC
CGTCACGGTCGTAGCGCACCGCGGCTTTGTCCACCGACCGCTCGATGGTTTGCACGCTGACCAGCTCGCCGGCCGCCTGG
```

FIGURE 6(continued)

```
GCTGCCTCGGCCGCTACTTCCAGCGCGGTCAGGGCGCGCCGGGCGTCGCCGGCCGCGAGTTGCACCAGCAGGTCGACGGC
CTCAGGCGCTACCGCGACTGCCCTGCCCAGGCCGCGGGGGTCATCGATCGCGCGTTGTACTACCGCGCGGGTGTCCTCGG
CCGTCAGCGGCCGCAGCTGCAGGATCAGCGACCGCGACAGCAGCGGTGCCACCACCGAAAACGACGGGTTCTCGGTGGTC
GCCGCCACCAACAGCACCACCCGGTGTTCCACCGCCGACAGCAGGGCGTCTTGTTGGGTCTTGGAAAATCGGTGCACCTC
GTCGATGAACAGCACGGTCTGCTCGCCGTGAAGCAGCGCTTTTCGCGAATTCTCGATGACCGCCCGCACTTCCTTGACGC
CGGCCGACAATGCCGACAGGGCCTCGAACCGGCGGCCGGTGGCCTGCGAGATCAACGCCGCCAGCGTTGTCTTGCCGCTG
CCCGGGGGACCGTAGAGGATCACCGACGCCACCCCCGAGCCCTCGACCAGCCGGCGCAACGGCGAACCGGGCGCCAGCAA
GTGGTCCTGGCCGACCACTTCGTCCAGCGACGCCGGACGCATCCGCACCGCCAGCGGTGCCCCGGCCGAAGCGCCCAGGT
CATGGCCGGACGTCATCGGTACGCCGGGCACGTCAAACAGACCGTCGGACACGGCTTCAGGCATACCACGCCCACCTGAC
GACGCGAACGTTCGCCGAAGACGCCACACGAATAATCCGCGCGCCTTCGGCAAATATTTGCTAAGTTCCGGTTTGCTTAG
CGTCGCGCGGGTACCGATAAAAGCGAACTACGAAGCGATTGGGACAGCGATGAGCCAGCCGCCAGAACATCCAGGCAATC
CGGCCGACCCCCAGGGCGGCAATCAGGGCGCTGGAAGCTACCCGCCGCCCGGCTACGGAGCGCCTCCCCCGCCACCAGGC
TACGGCCCACCCCCGGGGACCTACCTGCCTCCCGGCTACAACGCACCCCCGCCGCCCCCCGGCTATGGCCCACCGCCGGG
CCCGCCGCCTCCCGGTTACCCGACGCATCTGCAATCGTCGGGTTTTAGCGTGGGCGACGCGATCAGTTGGTCATGGAATA
GGTTCACGCAGAACGCCGTAACGCTCGTCGTCCCGGTGCTCGCCTACGCTGTGGCGTTGGCCGCGGTCATCGGCGCGACG
GCCGGGCTCGTTGTCGCCCTATCGGACCGTGCTACTACCGCATACACCAACACCTCCGGCGTCTCTAGCGAATCCGTGGA
CATCACGATGACCCCGGCCGCGGGCATAGTCATGTTCCTCGGCTACATCGCTCTATTCGCCCTGGTGCTCTACATGCACG
CCGGAATTCTGACCGGCTGCCTTGACATTGCCGACGGAAAGCCGGTGACCATCGCGACGTTCTTTAGGCCGCGCAATCTG
GGCCTGGTGCTGGTCACCGGACTGCTGATCGTCGCCGTCACCTTCATTGGTGGCCTGCTCTGTGTCATTCCCGGCCTGAT
CTTTGGCTTCGTCGCCCAGTTCGCCGTCGCTTTTGCCGTCGACCGTTCCACTTCGCCGATCGACTCGGTAAAGGCCAGCA
TCGAGACGGTCGGGTCCAACATCGGTGGCAGTGTGCTGTCGTGGCTCGCTCAGCTCACGGCGGTGCTCGTCGGCGAACTG
CTGTGCTTTGTCGGCATGCTGATCGGCATTCCGGTCGCCGCGCTCATCCACGTCTACACCTACCGGAAGCTGTCGGGTGG
CCAAGTCGTTGAGGCAGTCCGGCCAGCGCCCCGGTCGGCTGGCCGCCCGGCCCCAGCTCGCATAGTCGGCACCCGCCG
ACGCCGGCTGGCCGTCTTGGCCCGCTGGATTTGTCACGCGCTCACCCGAATTGGCATCCGGGGCCTGGAACGCGTTAGGG
CAGTGGCTTTCCCACAGGTTGACGTAAATGACCTCCAAGATAGGTATCGAACCAAGGTTGCGGCCGATGTGTACGTAGTT
CGAGAGTTCGCTGATCTGATCACTCGCGTGGTCGATGCAGTCGACGGAACCGGCAGCCGCCACCCAAGGGTGCGCAGGTG
GTTAGCAAATCGCCGACGAACACGACGCCACCGCGTCATGCGCCATCGCCGACCCCGCCTTGGTGGCTGAGAGCCGCTCG
CCGGCGTTAAGCTGCCCAACATCATGGGCATTCAACGCGCCGTTCTCCTCATTGCCGACATCGGCGGATACACAAATTAC
ATGCACTGGAACCGCAAGCACCTGGCCCCACGCGCAGTGGACGGTGGCACAGTTGCTGGAGTCCGTCATCGACGCTGCCAA
GGGCATGAAGTTGGCGAAGCTGGAGGCGCACGCCGCGCGTTTTTTTGGGCACCAGGGGGGCAACACCAGTGTCCTGGTATGC
GACCGGCCCCCGCAGATGCGCCAGAGGTTCCGCACGCGGCGCGAGCAGATCAAAAAAGACCATCCCTGCGACTGTAAGAG
TTGCGAGCAGCGGGACAACCTGTCGATCAAATTCGTCGCCCATGAGGGCGAAGTGGCCGAACAAAAGGTGAAGCGCAACG
TCGAACTCGCTGGCGTTGATGTCATCCTGGTGCACCGCATGCTGAAAAATGAGGTGCCAGTGTCGGAATATCTATTCATG
ACCGACGTCGTAGCGCAGTGCCTCGACGAGTCGGTGCGAAAACTAGCGACGCCGCTGACACATGACTTCGAGGGCATCGG
AGAAACGTCGACACACTACATCGACCCTCGCCACGTCCGACATGCCGCCGGCGGTGCCAGACCACAGCTTCTTCGGCCTGC
TGTGGGCGGATGTGAAGTTCGAATGGCACGCGTTACCGTACCTGTTAGGTTTCAAGAAGGCCTGTGCAGGTTTCCGCAGC
CTGGGCCGCGGCGCCACCGAAGAGCCCGCCGAAATCGGCTAATCGGGTTCGCTTGGCTCGATCGCCGATGATCTCGACCG
CCACGACCGACCCCCTCACCTCGGTCGAACCTCGGCGAACCAACGCGGCAACGCCAGCCCATGATCATTTGATTGGGTCC
ACGGAAGCAGGTAGCTTCCGTCGCATGCTTTTTGCGGCTTTGCGTGATGTCCAATGGCGAAAACGACGCCTTGTCATCGC
AATCGTCAGCACCGGCCTAGTTTTCGCGATGACGCTCGTTCTGACCGGACTTGTGAACGGGTTTCGGGTCGAGGCCGAGC
GAACCGTCGATTCCATGGGTGTCGACGCATTCGTGGTCAAGGCCGGCGGCAGGACCGTTCCTGGGTTCGACACCATTC
GCCCAAATCGACCTGCCCCAGGTTGCTCGTGCGCCTGGCGTCTTGGCTGCCGCCCCACTAGCGACTGCGCCGTCGACGAT
CCGGCAGGGCACGTCAGCGCGAAACGTCACCGCGTTCGGGGCACCAGAGCACGGACCCGGCATGCCGCGGGTCTCGGACG
GTCGGGCGCCATCGACGCCGGACGAGGTCGCGGTGTCGAGCACGCTGGGCCGAAACCTCGGCGACGATCTGCAAGTGGGT
GCGCGCACTTTGCGGATCGTCGGCATCGTGCCCGAGTCAACCGCGCTGGCAAAGATTCCCAACATCTTCCTGACCACCGA
AGGCCTACAGCAGTTGGCATACAACGGACAGCCGACAATCAGTTCGATCGGGATCGACGGGATGCCCGACAGCTCCCGG
ACGGCTATCAGACCGTCAATCGAGCGGATGCTGTCAGCGATCTGATGCGCCGTTGAAGGTCGCGGTGGATGCGATCACG
GTTGTGGCGGTCTTGCTGTGGATCGTTGCGGCGTTGATCGTCGGCTCGGTGGTCTACCTCTCTGCGTTGGAGCGGCTGCG
TGACTTTGCGGTGTTCAAGGCGATCGGCGTGCCGACGCGCTCGATTCTGGCCGGGCTGGCGCTGCAGGCGGTCGTCGTCG
CGCTGCTCGCGGCGGTGGTTGGCGGCATCCTTTCGCTGCTGTTGGCGCCGTTGTTCCCGATGACTGTCGTGGTACCCCTG
AGTGCCTTCGTTGGCGCTACCGGCGATCGCGACTGTGATCGGTCTGCTGGCCAGCGTCGCAGGACTGCGGCGCGTGGTGGC
GATCGATCCGGCACTGGCGTTCGGAGGTCCCCTAGCCATGGGCGGCCTAACCATTTCCGACCCTGGTCGTCGAGTATTCCAG
CGGCGGGTACGCCGTGCGGCCCGATCGACGGGTAAGCCTCGACGTGGCGCCGGGGTCGCTGGTGATCTTGCTTGGGCCCA
GCGGCTGCGGGAAGACGACCCTCTTGTCCTGCCTCGGCGGCATCCTGCGCCCGAAGTCCGGCTCAATCAAGTTTGACGAT
GTCGACATCACGACGCTGGAGGGCGCCGCGCTGGCGAAGTATCGGCGTGACAAGGTAGGGGATCGTCTTCCAGGCGTTCAA
CCTGGTCTCGAGCCTTACCGCCCTGGAGAACGTGATGGTCCCGCTGCGCGCGGCCGGCGTGTCACGAGCGGCCGCGCGTA
```

FIGURE 6(continued)

```
AGCGTGCCGAGGACCTGCTGATCCGAGTCAATCTCGGCGAACGAATGAAACACCGCCCGGGTGACATGAGCGGCGGCCAG
CAGCAACGCGTCGCGGTCGCCCGCGCGATCGCGCTGGACCCGCAATTGATCCTTGCCGACGAACCGACCGCGCACCTGGA
CTTCATCCAGGTGGAGGAGGTGCTGCGGCTGATCCGCTCGCTAGCGCAGGGCGACCGTGTGGTGGTGGTCGCGACCCACG
ACAGCCGGATGCTGCCGCTGGCCGATCGCGTCCTTGAGCTGATGCCGGCGCAGGTGTCGCCGAATCAGCCACCCGAAACG
GTGCACGTGAAAGCCGGCGAGGTGCTGTTCGAGCAGTCCACAATGGGCGATCTGATCTACGTGGTGTCCGAGGGCGAGTT
CGAGATTGTGCGCGAATTGGCCGACGGCGGTGAGGAATTGGTCAAAACCGCCGCGCCTGGGGACTACTTCGGTGAAATCG
GCGTGCTGTTTCACCTGCCACGCTCGGCAACGGTACGGGCTCGCAGCGACGCGACAGCCGTCGGTTATACGGCGCAGGCG
TTTCGGGAGCGGCTGGGTGTGACGCGGGTGGCCGACCTGATTGAGCACCGCGAGCTTGCCAGCGAATAGTTCGGCACCAA
GTCGCGATCCCTGAGGGTTGCGATGGGCGCGGCGCCGCCGCTGAATCGACCGCCCCCACTGAGCCGCCGTGGAATACTC
GATGAATCCTGCGGGCGTGTCCGCACTGCGTGTGGCTATGGAGTTGGGGAACATGTTGCTTGGGATAAGAACGTGAATGA
GGGACCGCTCTTCACAATGTCAGGCACTGCCGTGAGAAGTCCGCTACTCGATCGGTGTATGTGAGCAGTCCTGGCATGG
GCCGAGATGCCAAGAGCCGCATCTCATGACCACCGCGCGACGACGGCCCAAGCGGCGTGGTACCGATGCGCGAACCGCGC
TGCGCAACGTTCCGATACTCGCCGATATCGACGACGAACAGCTCGAACGACTCGCAACCACCGTAGAACGCCGCCACGTG
CCCGCTAACCAGTGGCTCTTTCATGCCGGAGAACCAGCGGACTCCATCTATATCGTCGACTCGGGGCGGTTCGTCGCTGT
TGCCCCAGAGGGACACGTATTTGCTGAGATGGCATCCGGCGACTCGATCGGAGACCTGGGGGTGATCGCCGGGGCTGCCC
GCTCAGCGGGAGTGCGAGCTCTGCGAGACGGCGTGGTGTGGAGGATCGCCGCGGAGACGTTTACCGACATGCTCGAGGCA
ACCCCGCTACTGCAATCGGCGATGCTGCGAGCGATGGCGAGAATGCTACGCCAGTCACGACCCGCCAAGACGGCTCGGCG
TCCGCGGGTCATCGGCGTGGTATCGAACGGGGACACCGCCGCGGCCCCGATGGTCGACGCGATCGCTACTTCACTGGACT
CGCACGGTCGAACTGCCGTGATTGCGCCGCCCGTCGAAACCACCTCCGCCGTTCAGGAGTACGACGAGCTCGTCGAGGCG
TTCAGCGAAACCCTCGATCGCGCGGAGCGAAGCAACGATTGGGTCTTGGTGGTCGCCGACCGAGGCGCCGGCGACCTGTG
GCGGCACTACGTTAGCGCGCAAAGCGACCGACTCGTGGTCCTGGTGGATCAACGGTATCCGCCGGATGCGGTCGATTCGC
TTGCTACCCAACGGCCAGTGCACCTGATCACATGTCTGGCAGAACCGGATCCAAGTTGGTGGGATCGGTTGGCGCCGGTT
TCGCATCATCCGGCCAACTCCGACGGCTTCGGTGCCCTTGCTCGCAGAATCGCCGGCCGATCGCTCGGCCTGGTGATGGC
CGGTGGCGGAGCCCGGGGACTGGCGCATTTCGGTGTTTACCAAGAGCTCACCGAAGCCGGCGTCGTCATCGATCGGTTTG
GCGGAACAAGTTCGGGTGCAATCGCTTCCGCAGCGTTCGCGCTGGGGATGGACGCCGGGGATGCGATCGCCGCGGCGCGA
GAGTTCATCGCAGGAAGCGACCCACTCGGCGACTACACGATCCCAATATCCGCCCTCACGCGAGGTGGACGCGTCGATCG
TCTGGTGCAGGGATTCTTCGGCAACACGTTGATCGAACATCTGCCCAGAGGGTTCTTCTCCGTCTCCGCCGACATGATCA
CCGGCGATCAGATCATCCATCGGCGGGGATCCGTCTCGGGCGCCGTGCGCGCATCGATCTCGATCCCCGGTCTCATCCCG
CCAGTGCACAATGGCGAGCAGCTGCTCGTCGACGGTGGGCTGTTGAACAATCTGCCGGCCAACGTGATGTGCGCCGATAC
CGATGGCGAAGTCATCTGCGTCGACCTCCGCCGAACGTTCGTGCCGTCGAAGGGCTTTGGCCTGCTGCCGCCAATCGTTA
CGCCGCCCGGGCTCCTCCGGCGGCTTTTGACCGGCACGGATAACGCGCTACCACCGCTGCAAGAGACGTTGCTGCGCGCC
TTCGACCTTGCCGCCTCCACCGCAAACCTGCGCGAGCTTCCTCGCGTTGCGGCCATCATCGAGCCCGACGTGTCGAAGAT
CGGAGTGTTGAACTTCAAGCAGATTGATGCCGCCCTAGAGGCTGGGCGGATGGCAGCCCGTGCGGCTTTGCAAGCACAGC
CGGACCTGGTGCGCTGAACCCGACCAAGTGCCGCTACGGCCCACTCAGGTGTCCGGCACCGGGCGTACGCGCTGCGCCGG
GCGGTCCGGTGTGATCTCATCAGCAGCTATGAGCATCAAAGTTGCGCTGGAGCACCGCACCAGCTACACCTTTGACCGGC
TGGTGCGGGTGTATCCGCACATCGTGCGGCTACGCCCGGCGCCGCACTCCCGCACCTCCATCGAAGCCTACTCGCTCGCC
ATCGAGCCCGCCGACCACTTCATCAACTGGCAGCAGGACGCGCTGGGCAACTTTCTGCGCGCGGCTGGTCTTTCCGAATCC
CATGCGCCAACTGCGTATTACCGTCGGGCTTATCGCCGACCTCAAGGTGATCAACCCCTTCGACTTCTTTATCGAGGACT
GGGCCGAGATATGGCCCTGCGCAGGGATGGCCTACCCCAAGGCGCTCGCCGATGACCTGAGGCCGTACTTGCGGCCGGTC
GACGAAGACGGCGACGGTTCGGGCCCCGGCGAGCTCACGCAGGCCTGGGTGCGCAACTTCACGGTGCCCGATGGCACCCG
CACCATCGACTTCTTGGTCGCACTCAACCGCGCGATCAACGCCGACGTCGGCTACTGCGTGCGCATGGAGCCCGGAGTTC
AGACACCGGATTTCACGCTGCGCACCGGCGTCGGCTCGTGCCGGGACTCGGCGTGGCTGCTGGTCTCGATCCTGCGTCAG
TTCGGGCTGGCCGCCCGGTTCGTGTCCGGCTACCTGGTTCAGCTGGCATCCGACATCGAAGCGCTCGACGGGCCGTCGGG
GCCCGCCGCCGACTTCACCGACCTGCACGCGTGGGCGGAGGCATACATCCCGGGTGCCGGCTGGATCGGGCTGGACCCGA
CGTCGGGGCTGTTGGCCGGCGAGGGCCACATTCGGCTGGCGGCTACGCCCCCACCCCGCCAGCGCGGCACCCATCAGCGGC
GGCACCGACGTGTGCGACACCGTGCTGGAGTTCTCCAACACCGTCACCCGCGTACACGAAGACCCACGTGTCACGTTGCC
CTACACCGACGAGTCCTGGAAGACCATCTGTGAGGTGGGCCAGCGCGTCGATGAGCGGCTGGCCGCCGCCGACGTCCGGC
TGACCGTCGGCGGCGAACCGACGTTCGTGTCGGTGGATAACCAGGTCGCCGAAGAGTGGCGGACGGCGGCCGACGGCCCA
CACAAACGCGAACGGGCATCCGACCTGGCCGCCCGCTTGAAGGCGGTGTGGGCCCCGCAGGGACTCATCCACCGCGGTCA
GGGCAGGTGGTATCCCGGAGAGCCGTTGCCGCGCTGGCAGATTGCGCTGTATTGGCGCACCGACGGGCGGCCGCTGTGGA
CCAACGACGCGCTGTTGGCCGACCCCTGGGGCGCCCCGCCCGCCGACCCCGTCGACGACGACGCGGCCTACCGGGTGCTC
GCCGGGATCGCCGACGGCTTGGGGCTGCCGATCTCGCAGGTGCGGCCCGCTACGAAGACCCGTTGAGCCGGCTGGCTGC
GGCCGTGCGAATGCCAGCCGGCGACCCGGTGGAATCCGGTGACGACCTCGGCTGCGACACCAACCCCGACACCCCCACCG
GCCGCGCCGCGCTGCTGGCGCGCCTCGATGAGGCCATCACCTCTCCGGCTGCGTACGTGCTGCCGCTGCACCGCCGCGAC
GACGGGCAAGGCTGGGCCAGCGCGAACTGGCGGCTGCGCCGCGGTCGCATCGTGTTGCTCGAAGGGGATTCGCCGGCGGG
CCTGCGGCTGCCGCTGGATTCGATCAGCTGGCGCCCACCCCGGGCATCGTTTGACGCCGACCCGGTAGCTGTGCGATCCA
```

FIGURE 6(continued)

```
CATTGCCGGCGGAGCTCCACACCGACCGGGCCGTAGTGGAGGATCCCGAGACGGCTCCGACCACCGCGTTGGTCGCCGAG
GTCCGGGGTGGGCTGGTGCACATCTTCTTGCCGCCCACCGACGCGCTCGAGCACTTCATCGACCTTGTCGCCCGAGTCGA
GGCCGCGGCGACGACGGCCAACTGCCCGGTGGTGATCGAGGGCTACGGCCCACCCCCGGACCCGCGGCTGACGTCCACCA
CAATCACCCCCGACCCCGGCGTCATCGAGGTCAACATCGCGCCCACCGCCTCTTTTGCAGAACAACGGCAACAGCTGGAA
ACCCTGTATCAACAAGCGCGCCTGGCCCGACTCACCACCGAAGCGTTCGACGTCGACGGCACGCACGGCGGCACCGGCGG
CGGCAACCACATCACGCTTGGCGGCGTCACACCCGCGGACTCACCGCTGCTGCGCCGGCCCGACCTGCTGGTTTCACTGC
TGACCTACTGGCAGCGACACCCGTCGTTGTCCTACTTGTTCGCCGGGCGTTTCGTCGGCACCACGTCACAGGCGCCCCGG
GTTGACGAGGGCCGCGCCGAGGCGCTCTACGAACTCGAGATCGCGTTCGCCGAGATCCTCCGGCTGTCGCCGTCGTCCGG
GGGCGGCCGGCCCCAACCGTGGGTGACCGACCGCGCGCTGCGGCACCTGCTCACCGACATCACCGGCAACACCCATCGCG
CCGAATTCTGCATCGACAAGCTCTACAGCCCCGACAGCGCCCGGGGCAGGCTCGGCCTGCTGGAGCTCCGCGGGGTTCGA
ATGCCGCCGCACCTGCACATGGCGATGGTGCAGTCGCTGCTGGTGCGCTCGCTGGTGGCGTGGTTCTGGGACCAACCGCT
GCGCGCCCCGCTGATCCGCCACGGCGCCAACTTGCACGGTCGATATCTATTGCCGCACTTCTTGATTCATGACATCGCCG
ACGTCGCAGCCGACCTGCGCGCGCACGGCATCGCGTTCGAGACTAGCTGGCTGGACCCGTTCACCGAGTTCCGCTTCCCG
CGCATCGGCACCGCCGTATTCGACGGCATTGAGATCGAGCTGCGCGGGGCCATCGAGCCATGGCACACCCTTGGCGAGGA
GGCCACCGCGGCAGGCACCGCGCGCTATGTCGACTCGTCGGTCGAGCGCATCCAGGTCCGCATCATCGGCGCCGACCGGC
ACCGCTACGTGGTGACCTGTAACGGCTACCCGATGCCGTTGCTGGCTACCGACAACCCCGACATCCACGTGGGTGGTGTG
CGGTTCAAAGCGTGGCAGCCGCCCAGCGCGCTACACCCGACCATCACGGTCGACGGCCCGTTGCGGTTCGAGCTCATCGA
CATCGCCACCGCTACCTCGTGCGGCGGCTGTACCTACCATGTCGCCCATCCGGGCGGCCGCGCCTACGACGAGCCCCCGG
TCAACGCTGTGGAGGCGGAGGCCCGCCGCGCCCGGCGCTTCGAGGCGACCGGCTTCACCCCGGGCAAGCTCGACCTGTCC
GACATCCGGGAGAAACAGGCCAGGATATCCACCGATATCGGCGCGCCGGGCATCCTCGACCTACGACGCGTGCGTACCGT
GCAACAGTAATGGCACCCTCAGCTTCTGCCGCTACCAACGGCTACGACGTCGACCGCCTGCTGGCCGGATACCGCACCGC
GCGTGCCCAGGAAACACTGTTCGACCTGCGGGACGGCCCGGGAGCCGGCTATGACGAATTCGTCGACGACGACGGCAACG
TGCGACCGACCTGGACCGAGCTCGCCGACGCGGTCGCCGAACGTGGCAAGGCGGGGCTGGACCGGCTGCGCTCGGTGGTG
CACAGCCTGATCGACCACGACGGCATCACCTACACCGCAATCGATGCACACCGGGACGGCGCTGACCGGCGACCATGATCT
GGAACCGGGGCCGTGGCGCCTGGACCCGCTGCCGCTGGTGATTTCCGCGGCCGATTGGGAAGTGCTGGAGGCCGGCTTGG
TGCAGCGATCGCGCTTGCTTGATGCCATCCTCGCGGACTTGTACGGGCCCCGCAGCATGCTCACCGAGGGTGTCCTGCCG
CCAGAGATGCTGTTCGCTCATCCCGGCTACGTGCGTGCCGCTAACGGGATCCAGATGCCTGGGCGCCACCAACTTTTCAT
GCACGCCTGTGATCTCAGCCGGTTGCCCGACGGGACTTTTCAGGTCAACGCCGACTGGACGCAGGCGCCCTCGGGCTCCG
GCTATGCGATGGCCGATCGACGTGTCGTCGCGCGACGCCGTTCCCGATCTGTACGAGGAACTGGCGCCGCGACCCACCACA
CCGTTCGCCCAGGCGCTCCGGCTGGCACTGATTGACGCGGCACCGATGTCGCCCAAGACCCCGTCGTGGTGGTGCTCAG
CCCGGGCATCTATTCAGAAACCGCTTTCGACCAGGCGTATCTCGCAACGCTGCTGGGTTTCCCGCTAGTGGAAAGCGCGG
ACCTGGTGGTGCGCGACGGCAAGCTGTGGATGCGTTCGCTGGGCACGCTGAAACGCGTTGACGTCGTTCTTCGCCGCGTC
GATGCCCACTACGCGGATCCACTGGATCTACGCGCCGATTCCAGGCTCGGTGTCGTCGGTTTGGTGGAAGCGCAGCACCG
CGGAACAGTGACCGTCGTCAACACGCTGGGCAGCGGCATCCTGGAGAACCCAGGCCTGTTGCGCTTCCTGCCGCAGCTAT
CCGAGCGCCTGCTCGACGAAAGCCCGCTGCTGCACACGCTCCGGTCTACTGGGGCGGCATCGCCAGCGAACGCTCACAC
CTACTGGCCAATGTCTCGTCGCTGCTGATCAAAAGCACTGTCAGCGGGGAAACTCTTGTCGGACCGACACTTTCGTCTGC
ACAACTGGCCGATCTGGCAGTGCGTATCGAGGCGATGCCGTGGCAGTGGGTGGGCCAGGAGCTGCCGCAGTTCTCGTCGG
CGCCCACCAACCATGCCGGGGTGTTGTCGTCCGCCGGGGTAGGCATGCGACTGTTCACCGTTGCCCAGCGCAGTGGTTAC
GCGCCGATGATCGGCGGCCTCGGCTATGTACTGGCGCCCGGCCCTGCCGCATATACGCTGAAAACCGTTGCAGCAAAAGA
TATCTGGGTGCGCCCAACGGAGCGTGCGCATGCCGAGGTGATAACGGTGCCGGTGTTGGCGCCGCCGGCCAAAACCGGAG
CGGGCACCTGGGCGGTCAGCTCTCCGCGCGTGCTGTCCGATCTGTTCTGGATGGGCCGCTACGGCGAGCGCGCGGAGAAC
ATGGCCCGGCTGCTGATCGTCACCCGCGAGCGCTACCACGTTTTCCGGCACCAGCAGGACACCGATGAAAGCGAGTGCGT
GCCGGTGCTGATGGCCGCGCTGGGCAAGATCACCGGATATGACACCGCAACTGGCGCCGGCAGCGCTTACGACCGGGCCG
ACATGATCGCGGTCGCCCCGTCGACACTGTGGTCTTTGACCGTGGATCCGGACCGGCCGGGTTCCCTTGTTCAGTCGGTG
GAGGGGCTGGCACTTGCCGCCCAGGCGGTGCGCGACCAGCTGTCCAACGACACCTGGATGGTGCTGGCCAATGTGGAACG
CGCGGTGGAGCACAAGTCCGACCCGCCGCAGTCGCTGGCAGAGGCGGACGCCGTGCTTGCGTCGGCTCAGGCGGAGACGC
TAGCCGGCATGCTGACGTTGTCGGGGTGGCCGGCGAGTCGATGGTCACGACGTGGGCTGGACGATGATGGACATCGGC
AAGCGTATCGAACGCGGCCTGTGGCTGACCGCGTTGCTACAAGCCACGTTGAGCACCGTGCGCCACCCCGCCGCCGAGCA
AGCCATCATCGAGGCAACCCTGGTGGCGTGTGAATCGTCGGTTATCTATCGGCGCCGCACCGTAGGCAAGTTCAGTGTCG
CCGCTGTGACCGAGCTGATGTTGTTCGACGCCCAGAACCCGCGCTCGCTGGTGTATCAGCTGGAACGGCTGCGCGCCGAC
CTGAAAGACCTGCCTGGCTCGTCGGGATCGTCTCGTCCGGAACGGATGGTGGACGAGATGAACACCCGCCTGCCGCCGCTC
ACACCCAGAAGAGTTGGAAGAGGTCTCCGCCGACGGGCTGCGCGCCGAGTTGGCGGAACTGCTGGCCGGGATACATGCCT
CGCTGCGTGACGTGGCCGACGTCCTCACCGCCACTCAGTTGGCGTTGCCCGGCGATGCAACCGCTGTGGGGTCCAGAC
CAACGGCGGGTGATGCCGGCCTAAACGGTGCGACGGCTGTGAGCGGCTCGAAATCCGGGGCCACCTCGTCGACGACGGT
GTGGATGAACCGCATCTTCTCCAGCACAGCGGCCGGCAGCACAAAGGGGTATAGGTCGTCGTGGCCCATCGAGCGATTGA
CCATGTTCAGCGACCACGACAGCGGCAGCCACTTGTCGATGATGGTATTAAAAGCGCTGGGGCCCAACGCCGGCCGGTCG
```

FIGURE 6(continued)

```
AAGGTTGCCGACGCCGGTGCCAGGCCGCACCAGGCCGCGGTGTCCAGGGCGTCGCGGATATGCAGGTAATGAGCGAACGT
CTCGGCCCAATCCTCACTCGCGTGCATGGTCGCATACGACGAGACAAAGCTGTCCTGCCAACCTTCCGGCGGGCCGCCAC
GGTAATGCCGATCCAACGCCTGGGAGTAGTCAGCGTCCGGGTCTCCGAACAACTCGTTGAACCGGGACAGATAGTCGCTT
GACGAGGCGATGAGTCGATAGAAGTAGTAGTGCCCGATCTCGTGGCGGAAGTGCCCAAGCAGGGTCCGATACGGCTCGTC
CATCTCGACCCGCAGCTGCTCCCGATGCACATCGTCGCCTTCGGCGAGATCCAGTGTGATGACTCCGTTCTGGTGTCCGG
TGGTCACGTTCTCGTGCGCGCTGGACAATAGCCGGAAGGCCAACCCATGGTCAGGATCCTGGTCGCGGCCGACGATCGGC
AGCTTCAGCTCGTGTAGCTCGGCGATCAGCCGCCGCTTGGCACCTTCGGCTCGGGCGAACTCCGCCAGCCCGGCGGTGTT
GGTATCGCTGGGCCGCTCGATGGTCAGCACACAAGAACTGCAAAGTCCGCCGAGCTGATCACTGGGCACCAGCCAATTGC
ATTGCGCGAGGTGGAGATTGGCGCAGAGTTGGACATCGGCGTCGTCGGCGATGACCAGCAGCGCCATCCGCCCAAGAGAA
AACCCCAGCGCGCTGCCGCACGACAGGCAGGCGGAGTTCTCGAATGCCAGGCGCTGCCCGCAATTTGGACAGTGGAAGTC
ACGCATGCAGCGCATCACCTTCGAAGGGCACGACATCGACAGAAACGTCGATCACACTGTTCTCGGAGTTGGTGTAGATG
ATGCCGCGTAGCGGCGGCACGTCTGCGTAGTCGCGGCCGCGGCCCACGACGATGTAGCGCTGGTCGACCAACTGGTCATT
GGTGGGATCCAGCCCCAGCCACTCGAACCGCCCGGGCTGCTGCGGAGTCCACACCGAGGCCCAGGCATGCGTCGCGTCGA
TGCCGATCATCCGATCCTTTCCGGGCGGCGGGTCGGTGGCCAGGTAGCCCGACACATAACAGGCCGCCAAACCGTTGGCC
CGTAGGCAGGCGATCGCCAGCCTGGCGAAATCTTGGCATACCCCTTCGCGGGCCAGCAGCACCTCGTTGACTCCTGTGGA
AATCGTCGTGGAACCCGAGCGGTAGGTGAAGTCGGTGTAGATCCGCGACGCGAGATCGCGCAATACCTCGACCAGGGGGC
GTTTGGGCAGGAAGCTAGGAGCCGCGTACTCACGCACCGCATCGGTGATCTCCGGCGGGTTCAAGTCCAGGGTGAACTCG
GTGGCTAGCGATCCGGGCAGCCCGGCGGGCCGGGCCGCTCCCACGGTTGCAGCGCCGGCCCGCTGGTGTAAAGCCCGGG
CGGCGGCGGGGACACGTCGACGATGGAATCGCTGGTGATCGTCAAGGTGCGGTGCGGTTCGGTGACGTGGAAATAGGAGC
TGATGTTGCCGTACCCGTCGCGGCTGGTGGACCGGTCGGCGGGGCCGGGTCGATGGTCAGCCGGTGTGCGACACAACGC
TGCCGCAGCGAATTCCGCGGCGTGAGAAACCCGCGGCCATAGGAGCTGGTCACCACGTCGGAGTAGCGGTATTCGGTGCG
GTGTGTTACTCGATAGCGGTGAGTGCCCGACAACGGCAACGACAACGAGCTATCTGCTGACAAAAAGCTACCTCCTGGCT
GATCACATCACACGCCGGCGGCTCGTCCGGCGCGATCGTCGCGCAATGTGGCGCCAAGCGCACCATAGCCGGAGCACAAT
TAAAGCGTGGCTACCTGGGACGACGTCGCCCGTATCGTGGGTGGGCTGCCGCTGACCGCGGAGCAGGCACCGCACGACTG
GCGTGTTGGCCGCAAGCTGCTGGCCTGGGAACGGCCGCTGCGCAAGTCCGACCGCGAAGCCCTGACCAGGGCCGGATCGG
AGCCACCGTCCGGCGACATCGTCGGTGTCCGAGTGTCGGACGAGGGGTGAAGTTCGCCTTGATTGCCGACGAGCCGGGC
GTGTACTTCACCACCCGCATTTCGACGGCTATCCAGCGGTGCTGGTCAGGCTGGCCGAGATCGAGGTTCGCGACCTCGA
GGAGTTGATCACCGAGGCCTGGCTGATGCAGGCGCCGAAGCAGCTGGTGCAGGCGTTTCTCGCCAATTCAGGCTGACATG
CCCGACGGCCCGGGCGTTCGATTACCCGTTGTAGATCGGTGACACACGCTTGGACGATATCGGCGCGCACCACTTCGTT
GCTGCCACAAGCAGCCGATTGCAGTGTCGACGCGGTTGCGCGGGCGGCGGCCGCGTGCTCGTTCGCTGCCGTCGGATCCG
CGTCGGCCAGGCCGGTTCCCGCGGCGAGGTCGGTGAGCACGGCGTGCACGGGCGTTGGCAGCTTATCGCCACCAGGCCG
GCAATGGTGCCAGCCAGATGCAACACCGAACTGACCAGCAGGGCCAGGTAGACGGCCTGTTGATCGAGATCGCGGACAGT
GCTGCGCACCCCCATCGGCGGGGCGCTCGCCGCGCCACCATGGCAGCGTTGGCGCGCACCTCGATGAGCCCGTTCAGCT
GCTGATGCAGTCGATCAGCGGCTGCCATCGGCCAGTCGGGCGGGGCGCTGGTGGGATCGCTCACCGTGTTCACCAGCTCG
GCGAGGATGTCTCGCACAGCGGCCAACACGTCGGCGCGCGCAACATGACCACCGGGTCGGGCGGGAAGAGCAG
AATGCTGAACACGATAGCCAGCCCACCACCGACCAGCGCGTCGAAGAGGCGTTCGAAAACCACACTGCCGTTGGACGCGA
AGACCAAGACCAGCACCGCGGAGACGGCGGCCTGGTTGATGAACATTAAGCCTTGCGCGACCAACCCGCGTGCGCACAGC
ACCGCGACCGACAACGCGATGAACACCACCACACCCATGGCGATCGGTCCGGAACCAAGCAGAGCATGCACGCCAGCACC
CAGCACGATCCCCAGCGCCACCCCGACGATCATCTGTTGGGCACGTCGTGCGCGCAGCACGTTGGTCGCCGACATGCACA
CCACAGCCGAAATCGGCGCGAAGAACGCCTGCCGATGGTTGAACACGTCATGGGTGAGATACCACGCGAGGCCGGCGACG
ACCGATGTCTGGGTGATCGGCCACAGCACGGTGCGCAACCGTTGGGCGACCGCACGGCCGCCGCAGGCCGTCCTGACTAG
CAGCGAAGCGCTCATGAACGCCTATTTATTCACACTCGGGTGCGACGTCGTAACCGCAAAGATCTGGTCATGCCTGCTGG
ACCCGCTTGGGCTGGGCATCTATTCCGGACTCCTTACGTTGCTGAGCGGTAATGGGCGCCGGCGCGTCGGTGAGCGGATC
GACGCCGCCGCCGGTCTTCGGGAACGCGATCACCTCACGGATCGAGTCCATCCCGGCCAGCAGCGCGGTGGTCCGGTCCC
ACCCGAACGCGATTCCGCCGTGCGGCGGTGCGCCAAACATGAACGCCTCCAACAGGAATCCGAACTTTTCCTCCGCCTCG
GCCTTGTCCAGGCCCATCACCGCGAACACCCGTTCCTGGATATCACGGCGGTGGATACGCACCGAGCCGCCACCGATCTC
GTGGCCGTTGCAGACGATGTCGTACGCGTCGGCCAGCACGCTGCCGGTATCGGATTCGATGCGGTCCTCCCATTCCGGTT
TCGGCGCGGTGAAGGCATGGTGCACCGCGGTCCAGGCCCCGAGCCGACCGCGACCTCACCGGCGGCGGTCGCTTCGTCG
GCCGGCTCGAACAGCGGCGGGTCAACGACCCAGACGAATGCCCACGCATCGGGGTCAATCAGGCCCAGCCGGTTGGCGAT
CTCGACGCGGGCCGCGCCCAGCAGTGCCCGCGACGATTTGACCGGACCGGCCGAGAAGAAGATGCAATCGCCGGGTTTGG
CCCCGACATGGTCGGCCAGTCCGGTGCGCTCGGCCTCGGTCAGGTTTTTGGCCACCGGACCGCCCAGCGTGCCGTCTTCG
GCGACCAGCACGTAGGCCAGTCCGCGGTGGCCGCGCGCGTTGGCCCAGTCCTGCCAGCCGTCCAGCGTGCGCCGCGGCTG
CGACGCCCCGCCAGGCATCACCACCGCGCCCACATACGGTGCCTGGAAGACACGAAATGTGGTGTCGGAGAAGAAATCCG
TGCATTCGACGAGCTCCAGCCCGAACCGCAGGTCGGGTTTGTCCGTACCGAATCGGCGCATCGCTTCGGCATAGCCGATC
CGCGGGATGGGCGTCGGAATCCGGTAGCCTATCAGCGCCCACAGCTCGGTCAGAACTTCCTCGGAGATCGCGATGATGTC
CTCGGCGTCGACGAAGCTCATCTCCATATCGAGCTGGGTGAATTCGGGCTGGCGGTCGGCGCGGAAGTCCTCGTCGCGGT
```

FIGURE 6(continued)

```
AGCAGCGGGCGATCTGGTAGTAGCGTTCCATCCCCGCCACCATCAGCAGCTGCTTGAACAGCTGCGGGCTCTGCGGTAGG
GCGTAAAACGAACCGGGGTGCAGTCGGGCCCGGCACCAGGAAGTCGCGCGCTCCCTCCGGGGTCGAGCGGGTGATCGTCGG
CGTCTCGATCTCGACGAAGTCGTGACGCGCCAGCACCGCGCGCGCAGCGGCATTCACCCGGGAACGCAGTCGAATCGCCG
CAGCGGGGTCGTCGCGGCGCAGATCGAGGTAGCGGTACTTCAGTCGCAACTCCTCACCCGCCGGTTCGTCCAGCTGAAAC
GGCAGCGGCGCACATTCGCCCAGCACGGTCAACGACGTGGCGTTGACCTCGATCTCGCCGGTGGCGATCTCCGGGTTGGC
GTTGCCTTCCGGGCGGATCTCGACGACGCCGGCCACCGATACGCAGAATTCCGCACGCAGCCGGTGAGCCTGCGCCAGCA
CCTCAGTGTCCTGGGGGTCGCGGAACACCACCTGTGCGATGCCCGAAGCGTCCCGCAGATCGATGAAGATCACGCCGCCG
TGGTCGCGGCGGCGAGCCACCCAGCCGGCCAATGTCACCTGCTGCCCGGCGTCGCCTTCCCGTAGCAAACCCGCGGCGTG
GCTGCGCAGCACAAACACTCCCCTTCAACCGGATTAACCGACTGCTCAGTCTAGAGGTGCCCGCGGCGCACATCGGTCAC
GCAGGATAATTTCGGCTCATCTCAACAAACATTGCAACAGGCATTGCCCTAGTCGGACCCGGTGCCGTCGGAACGACGGT
CGCCGCGCTGTTGCACAAGGCCGGGTATTCGCCGCTGTTGTGCGGCCACACTCCGCGCGCCGGGATCGAGCTCCGGCGAG
ACGGCGCAGACCCCATCGTGGTGCCCGGTCCGGTGCACACCAGTCCTCGGGAGGTTGCCGGCCCGGTCGATGTGCTGATC
CTGGCGGTCAAGGCCACTCAGAACGACGCCGCACGTCCCTGGCTGACCCGCCTGTGCGACGAGCGCACCGTGGTGGCCGT
GCTGCAAAACGGTGTCGAACAGGTCGAGCAGGTCCAGCCGCATTGTCCGTCCTCGGCCGTGGTTCCCGCGATCGTGTGGT
GTTCGCCGAGACCCAGCCGCAAGGGTGGGTGCGCTTGCGCGGTGAAGCCGCACTGGTCGTTCCCACCGGGCCCGCGGCC
GAGCAGTTCGCCGGGCTGCTGCGCGGTGCCGGCGCCACGGTGGACTGCGACCCCGACTTCACCACGGCGGCCTGGCGCAA
ACTACTGGTCAACGCGCTGGCGGGATTTATGGTGCTGTCCGGACGGCGGTCGGCAATGTTCCGCCGCGACGACGTCGCGG
CATTGTCGCGCGCGCTATGTCGCCGAATGCCTGGCGGTGGCGCGCGCTGAGGGTGCCCGACTCGATGACGACGTCGTCGAC
GAAGTGGTCCGCCTCGTCCGGTCGGCCCCGCAGGACATGGGCACCTCGATGCTGGCCGACCGGGCAGCCCACCGGCCACT
GGAATGGGATTTGCGCAATGGGGTGATCGTCCGCAAGGCCCGCGCCCACGGCCTGGCCACCCCGATCAGCGACGTGCTGG
TGCCGCTGCTGGCGGCTGCCAGCGACGGTCCCGGATAGCAATGTAGCTAATGTCTAGATCATGTACCCCTGCGAGCGGGT
AGGCCTGAGCTTCACCGAGACCGCGCCTTACCTCTTCCGCAACACCGTCGACCTGGCCATCACGCCCGAGCAACTCTTCG
AAGTGCTCGCCGACCCGCAGGCCTGGCCACGCTGGGCAACGGTGATCACAAAGGTGACCTGGACCAGTCCCGAACCGTTC
GGCGCCGGCACCACCCGCATCGTCGAGATGCGCGGGGGTATCGTCGGCGACGAAGAGTTCATTTCGTGGGAGCCTTTCAC
CCGCATGGCCATTTCGGTTCAACGAATGCTCCACCAGAGCCGTCGGCGCGTTCGCCGAAGACTATCGGGTGCAGGCCATCC
CCGGTGGTTGCCGGCTGACCTGGACCATGCCGCAGAAACTCGCCGGCCCGGCGCGGCCGGCGCTGTTCGTCTTCCGGCCC
CTGCTGAACCTGGCGCTGCGCCGGTTTCTAAGGAATCTGCGCAGGTATACCGACGCTCGGTTCGCCGCTGCGCAGCAGAG
TTAGGCTGGATCGGCCGATTTCGGGAGCGTGCGATGACCTTCAACGAGGGTGTGCAAATCGATACCAGCACCACGTCGAC
CTCGGGTAGCGGTGGCGGGCGGCGCTTGGCCATCGGGGGCGGCCTCCGTGGGCTACTGGTGGTGGTCGCAATGCTGC
TCGGCGTCGATCCCGGTGGCGTGCTGAGCCAACAACCTCTCGACACCCGCGACCACGTAGCACCCGGTTTCGACCTGAGC
CAGTGCAGAACCGGGGCCGATGCCAACAGGTTCGTGCAGTGCCGGGTGGTGGCCACCGGTAACTCCGTGGACGCGGTATG
GAAACCGCTGTTGCCCGGCTACACCCGCCCACACATGCGGCTGTTCAGCGGCCAGGTAGGCACCGGATGCCGGACCGGCCA
GCAGCGAGGTCGGGCCGTTCTACTGCCCAGTGGACAAAACGGCCTACTTCGACACCGACTTCTTCCAGGTGCTGGTCACC
CAATTCGGTTCCAGTGGCCGCCCATTCGCGGAAGAGTATGTGGTGGCCCATGAATACGGCCATCACGTGCAGAACCTGCT
GGGGGTGCTCGGCCGCGCTCAGCAGGGTGCGCAAGGTGCTGCGGGCAGTGGCGTGCGCACGCAGTTGCAGGCGGACTGCT
ACGCCGGGGTGTGGGCATACTACGCGTCCACCGTCAAGCAGGAGAGCACCGGTGTGCCTTACCTGGAGCCGTTGAGCGAC
AAGGACATCCAAGACGCCCTCGCGGCCGCGGCAGCGGTGGGCGACGACCGTATCCAACAGCAGACGACCGGACGCACCAA
CCCCGAGACCTGGACGCATGGCTCGGCCGCGCAACGGCAGAAGTGGTTCACTGTCGGATACCAGACTGGCGACCCCAACA
TCTGCGACACCTTTTCCGCCGCGGACCTGGGGTAGGCGAATTACCAGGGACGAGTCGAGCACTGCACGCCGCTGCCGCCG
TCCTGCGACACCACCACCTGGCCGTCTACAACAATCTCGCAGGTGGAACTCCGGATTGACCCGCAGGCCGCGCTGGCCGT
GACGATCGCCCACTGGCTCGGGTTTGCCAGCGTGGCGGTATAGACCAGCGGCTGACCGCCAGCGATCGGAGTGTGCAAGG
TAATCATGTACTTCGATGAATCGGCATTGAAAGCCGCCATGCTGGGCGGATCGGCGCTCATGTACCGAATGTTGGCCATC
AGGTCGCTGGTGGTCGTGACGGTGTAGGTCACCTGATGCCCGACCGGATCCGCGCGGGCAATCGCCGGGATGACCCCGCT
GAGCGCGGCTCCGGCAAACGTCACCAGCGCGACGGCGCTTGGCACTGTGCGCACGGACGTCATATCTAAAACGCTACCGG
ATGCGTTACCGACGCCGGCCGGCACTGCATGCGATGACCGTCGCCCGCCATCCGGGCAAGCCGAATTGCGTGAGCCGCAC
CGCCATTAGCAGCCGAAAGCTGTCGTTGGCCTCGGGCTTCGCGCTCTGGAGGCGATCGCTGGTGTGAGCGTCTACGCAGT
TCAGAAAGCCTTTCCGAGCAACGCGCCGAGGTAACTTCAGATTTCGGCAGCCGGTTTACCCGCAGGTAAACCAGGGCGGG
TATGAAACGTGAGTGGGCGCCGATCTGAAGCAGCCGCAGGATGCCGATTCACCCCGAAAGGGGTTAGCCGCCGTAGGTT
CCTGACGACGGGCGCGGCAGCGGTTGTTGGGACAGGTGTCGGCGCGGGCGGGACCGCGCTGCTGTCGTCACACCCCGGG
GTCCTGCCGTCTGGTATCAACGTGGTCGGAGCGGCGCGCCTCCGGTGGGTGGTCTGCACCTGCAGTTCGGCCGGAATGCC
AGCACCGAAATGGTGGTGTCCTGGCATACCACGGACACCGTCGGCAATCCGCGAGTCATGCTGGGCACGCCAACCTCTGG
CTTCGGCAGCGTCGTGGTGGCCGAGACCCGGTCGTACCGGATGCGAAGTCCAATACCGAGGTGCGCGTCAACCACGCTC
ACCTGACCAACCTGACACCCGATACCGACTACGTCTACGCCGCGGTGCACGACGGTACAACTCCGGAGCTCGGGACCGCA
CGGACCGCACCGTCGGGTCGAAAACCGCTACGCTTCACCAGCTTCGGTGATCAGTCCACTCCCGCGTTGGGCAGACTGGC
CGACGGGAGGTACGTCAGCGACAACATCGGATCCCCCTTCGCCGGTGACATCACGATTGCGATCGAGCGTATTGCCCCGT
TGTTCAACCTGATCAACGGTGACCTGTGTTACGCCAACCTGGCACAAGACCGAATTCGCACCTGGTCGGACTGGTTTGAC
```

FIGURE 6(continued)

```
AACAACACCCGCTCGGCGCGCTACCGGCCGTGGATGCCGGCAGCGGGCAATCACGAGAACGAAGTCGGTAACGGGCCAAT
CGGTTATGACGCCTATCAGACCTACTTTGCGGTACCCGACTCGGGATCCAGCCCGCAACTGCGCGGGCTATGGTACTCGT
TCACCGCCGGCTCGGTGCGGGTGATCAGCCTGCACAACGATGATGTGTGCTACCAGGACGGTGGCAACTCCTACGTACGC
GGCTATTCGGGCGGCGAACAACGGCGCTGGCTGCAAGCCGAACTCGCCAACGCTCGGCGCGACTCGGAAATCGACTGGGT
GGTCGTCTGCATGCATCAGACCGCGATCTCCACCGCCGACGACAACGGTGCCGACCTCGGAATCCGGCAGGAATGGC
TACCGCTGTTCGACCAGTACCAGGTCGACCTGGTGGTGTGCGGCCACGAACACCACTACGAGCGGTCACATCCGCTGCGC
GGGGCCCTGGGCACCGATACCCGAACACCGATACCCGTCGACACCCGCAGCGACCTCATCGACTCAACCCGGGGAACCGT
GCACCTGGTAATCGGTGGGGGCGGCACGTCGAAGCCGACCAACGCGCTGCTCTTCCCGCAGCCTCGGTGCCAGGTGATAA
CCGGCGTCGGGGATTTTGATCCCGCGATCCGGCGTAAGCCGTCCATATTCGTGCTCGAGGATGCGCCGTGGTCGGCGTTC
CGCGACCGCGATAATCCTTACGGCTTCGTGGCCCTTCGACGTCGACCCGGGTCAACCCGGCGGCACTACCTCGATCAAGGC
GACGTATTACGCGGTGACTGGGCCGTTCGGGGGACTCACCGTCATCGACCAATTCACCTTGACCAAGCCGCGCGGCGGAT
AGCTCAGAACAGGGTCGCCTGAACGGGTACCAGTGCCGCTTCGGTCTCCGGCGGCGCCGGGCGATGATCACCCGCCAACC
GATACTTTGCGATCAGCGGTGCCACCCGTTCCCGCAGCATCTCGCGGTAGCTCGGCGGTAGATATGGCCCGCGCCGGTAC
AGTTCGCGGTACCGGCTGACCAGTTCGGGATGCGCGCGGGCCAGCCAGCACATGAACCAGCCGCGCGTCGAACCCCGCAG
ATGCAGGCCAAAGACCGTTACACCGGTGGCGCCTGCGGCCGCGATCTGGCCCAACAGTTGGTCAAGGTGCTCGCCGGAGT
CGGTGAGTTGTGGCAGCACCGGCGCGACCATCACGTGACAGTCCAAGCCGGCGGCGCGAATTGCGGTAATGAGCGCCAGC
CGCGCCTGCGGTGTTGGCGTACCCGACTCGACATCCCGGTGCAGCTCCGGGTCGCCAACGGCCAGCGACACCGCCACCGA
CACCGGCACTTGTTGGGCGGCCTCGGCGATCAACGGCAAGTCCCGTCGCAGCAGGGTGCCCTTGGTCAGGATCGACAGCG
GCGTACCGGATGCCGCCAGCGCGCCGATGATGCCCGGCATCAGGGCGTAGCGGCCCTCCGCGCGCTGGTAGGGGTCGGTG
TTGGTGCCCAACGCGACGGTCTCGCGCCGCCAGGACGGCCGGCGCAACTCGTGACGCAGCACAGCGGCCGACGTTGGTCTT
GACCACCACCTGGGTGTCGAAGTCGGTGCCCGGATTGAAGTCCAGGTACTCGTGGGGTGGGGCGGGCGAAACAATAGCGAC
AAGCATGCGAGCAGCCGCGGTAGCCGTTGACGGTGTAGCGAAACGGCAACGCGGCCGCGTTGGGCACCTTGTTCAGCGCT
GATTTGCACAACACCTCGTGGAAGGTGATGCCGTCGAATTGTGGCGCGCGAACGCTGCGGACCAGGCCGATCCGCTGCAA
CCCCGGCAGCGCCCCGTCGTCAACGGGCATCCCGTTCACCGCGACGGCTTGCCGGGCCCAACGCATACCATTATTCGAAC
AACCGTTCTATACTTTGTCAACGCTGGCCGCTACCGAGCGCCGCACAGGATGTGATATGCCATCTCTGCCCGCACAGACA
GGAGCCAGGCCTTATGACAGCATTCGGCGTCGAGCCCTACGGGCAGCCGAAGTACCTAGAAATCGCCGGGAAGCGCATGG
CGTATATCGACGAAGGCAAGGGTGACGCCATCGTCTTTCAGCACGGCAACCCCACGTCGTCTTACTTGTGGCGCAACATC
ATGCCGCACTTGGAAGGGCTGGGCCGGCTGGTGGCCTGCGATCTGATCGGGATGGGCGCGTCGGACAAGCTCAGCCCATC
GGGACCCGACCGCTATAGCTATGGCGAGCAACGAGACTTTTTGTTCGCGCTCTGGGATGCGCTCGACCTCGGCGACCACG
TGGTACTGGTGCTGCACGACTGGGGCTCGGCGCTCGGCTTCGACTGGGCTAACCAGCATCGCGACCGAGTGCAGGGGATC
GCGTTCATGGAAGCGATCGTCACCCCGATGACGTGGGCGGACTGGCCGCCGGCCGTGCGGGGTGTGTTCCAGGGTTTCCG
ATCGCCTCAAGGCGAGCCAATGGCGTTGGAGCACAACATCTTTGTCGAACGGGTGCTGCCCGGGGCGATCCTGCGACAGC
TCAGCGACGAGGAAATGAACCACTATCGGCGGCCATTCGTGAACGGCGGCGAGGACCGTCGCCCCACGTTGTCGTGGCCA
CGAAACCTTCCAATCGACGGTGAGCCCGCCGAGGTCGTCGCGTTGGTCAACGAGTACCGGAGCTGGCTCGAGGAAACCGA
CATGCCGAAACTGTTCATCAACGCCGAGCCCGGCGCGATCATCACCGGCCGCATCCGTGACTATGTCAGGAGCTGGCCCA
ACCAGACCGAAATCACAGTGCCCGGCGTGCATTTCGTTCAGGAGGACAGCCCAGAGGAAATCGGTGCGGCCATAGCACAG
TTCGTCCGGCGGCTCCGGTCGGCGGCCGGCGTCTGACCGCAACCGGGCCTCATGCTAGGCCACCGGCGACCGACGGACTT
CCCGCGCGAGCCGCTCCAAAAGCCTCAGCCGCTCGGGGTGGTCGGCTCGTCAAACGACAGCCCTATCAGCCGAGACACCA
CGTTGTGCAGCGCGTCAAACACCTCCAGGATCTCTTCTCGGCTACTCGAAACCCATGTTTGAAACGTATGACGCCCACCG
ACAAGAATGGCCGCCTTGAGGCCCTGCGGCCACGGTGGCGCAAGTGATTTCGGTGACTCCGGCTGGAAGCGGCGACTACC
CAGCCAGCCGCGAAATTACTTCGGCCACAACCGAATCCATCGAGACCGAAACTTGCTCACCCGTCGTCAAGTCCTTCACT
GCGACCGTCCCGGCCTCGATGTCGCGGTCGCCCGCTACCAACGCAACACGGGCGCCGGAACGAGCGGCCGCGCGCATCGC
GCCTTTGAGCCCGCGATCACCATAGGCAAGGTCAACCCGCACCCCGGCCGCGCGCAGTCGTCCAGCCAGCACCGCCAGCC
TGAGCTTGGCCGCCTCGCCAAGCGGCACGCCGAACACGTCGCACCGGGCGCTGTCCCCCGCCGTCTTGCCCTCGGCCCGC
AGCGCCAGCACGGTCCGGTCCACGCCCAGCCCGAACCCGATGCCCGACAAGTCCTGCCCGCCAAGCTGGTGCATCAGGCC
GTCGTAGCGCCCCCGCCGCCGATCCCCGATTGCGCACCAAGCCCGTCATGGACGAACTCGAAGGCGGTCTTGGTGTAGT
AGTCCAGGCCGCGCACCATGCGCGGGTTGATGACATAGGGCACTCCAAGCGCGTCCAGATGGGCGAGCACGGTGTCGAAA
TGCTGCTTGGCGACATCAGACAGATGATCCAGCAACACCGGCGCCGACGCCGTCATCGCACGCAATTCGGGTCGCTTGTC
GTCGAGCACCCGCAGCGGATTGATCCCTGCCGCGCCTGCGGGTGTCCTCGTCGAGATCGAGTCCAAACAAGAACTCCTGCA
ACAGTTCCCGGTACTGCGGACGGCAACTCTCGTCTCCCAGGGAGGTGATTTCAGCCGGAACCCGTCGAGACCCAACGAG
CGGAACCCGGCGTCGGCAATGGCGATCACCTCGGCGTCCAACGCCGGGTCGTCGACGCCGATCGCCTCCACCCCGACTTG
CTGTAACTGGCGATACCGGCCGGCCTGCGGACGCTCGTAGCGGAAAAACGGGCCCGCATAACACAACTTCACCGGCAGCG
CGCCGCGATCCAGCCCGTGTTCGATCACCGCACGCACCACCCCGGCGGTGCCCTCGGGCCGCAGCGTCACCGAGCGGTCG
CCACGGTCGGCGAACGTATACATCTCCTTGGACACCACGTCGGTGGATTCACCCACGCCCCGGGCGAACAGGGCGGTGTC
CTCGAAGATGGGCAGCTCGATGTGGCTATAGCCGGCTTGACGGGCCGCCGCGAGCAGCCCGTCGCGCACCGCGACGAACT
GCGCCGAGTCGGGCGGGACGTAGTCCGGTACCCCCTTGGGGGCCGAAAATGACGAGAATTCCGTCACCGGCTCAAGCCCT
```

FIGURE 6(continued)

```
CAAGGAACGGATTGAAGCGCCGCTCGGCCCCAATGGTGGTGGAGTTGCCGTGCCCGGGCAGCACCACCGTGCTGTCGTCG
AGCACCAGGAGTTTGTCGACGATGGAGCGCAACAGGTCGCGGCCGCTGCCGCCGGCCAAGTCGGTGCGGCCTATCGCACG
CTCGAACAGGGTGTCACCGGTGAACACGATGTCCTTGTCGTTGTTGGTCGCCTGCAGGACCCGGAAGACCACCGACCCGC
GGGTGTGACCCGGTGTGTGATCGATGTTGACCGAGATGCCGCCGAGGTCGATCTTGTCGCCGTCTCGGTCCAGCTCCACA
ACCTGTTTAGGCTCACGAAAGAACGCACCCGCAACCAGCTGCGCTATCCGCGGGCCCAGGCCGTAGATGGGGTCGGTCAG
CATGAACCGGTCGGCGGGATGCACATAGGTGGGGCAGCCGAAGGTGTCTGAGACCTTCTGCGCGGACCAGATGTGATCGA
TGTGTCCGTGGGTGAGCAGCACCGCGGCAGGGGTCAGCCGGTTCTTGTCGAGGATGCGACGCAGCGTGCCCATCGCACCC
TGGCCCGGATCGACGATGACGGCGTCGGTTCCGGGCCGCTCGGCCAGCACATAACAGTTACACGCCAGCAACCCCGCAGG
AAATCCGGTGATCAACACGGTTCCCAGTTTCCCATCCCCGGCGTCCGGGGACGAGGCGGGCCGCGAACATGGGCCACTTG
ACACCGGTCGCGGCGCCCCGATTAGCCTGTGCTTTCGTGCCGACCAATGCTCAGCGACGTGCCACAGCCAAACGCAAACT
CGAACGACAACTAGAGCGCCGCGCCAAGCAAGCCAAACGCCGTCGCATCTTGACTATCGTCGGTGGCTCACTCGCAGCGG
TGGCCGTGATCGTCGCGGTAGTCGTCACGGTGGTGGTCAACAAGGACGACCACCAGAGCACCACGTCAGCAACCCCCACC
GACTCGGCCTCGACCAGCCCCCGCAGGCCGCGACCGCTCCCCCGCTGCCGCCGTTCAAGCCGTCGGCCAACCTCGGCGC
CAACTGCCAGTACCCGCCGTCGCCGGACAAGGCCGTCAAACCGGTCAAGTTGCCCCGGACCGGCAAGGTACCCACCGACC
CGGCCCAGGTCAGCGTGAGCATGGTGACCAACCAGGGCAACATCGGTCTAATGCTGGCCAACAACGAATCGCCGTGTACG
GTCAATAGTTTCGTCAGCCTCGCGCAGCAGGGTTTCTTCAAGGGCACCACTTGTCACCGGCTGACCACCTCACCAATGTT
GGCGGTTCTGCAATGCGGCGACCCTAAGGGCGACGGCACGGGCGGTCCGGGCTACCAGTTCGCCAACGAATACCCCACCG
ACCAATACTCGGCGAACGACCCCAAGTTGAACGAGCCCGTCATCTATCCGCGCGGGACACTGGCCATGGCCAACGCCGGC
CCTAATACCAACAGCAGCCAGTTCTTCATGGTCTACCGGGACTCAAAGCTGCCACCCCAATACACCGTGTTCGGCACGAT
CCAGGCCGACGGACTGACCACCCTGGACAAGATCGCCAAGGCCGGCGTCGCCGGTGGCGGCGAAGACGGCAAGCCCGCCA
CCGAAGTCACCATCACGTCGGTGCTGCTGGATTAGCCCGACGCTCGCCGAGCAGACACAGAATCGCACGAAATCAGCCCG
CCCAATGCGATTCTGCGTCTGCTCGGCGGAGAAAAGCGCGTACGCGGCCGAGGTCACCGGTAGACGTCGTAGACACCT
TCGACGTTGCGGACGGCGTTGAGCAGGTGCCCGAGGTGCTTGGGGTCACCCATCTCGAAGGTGAATCGACTGATCGTCAC
CCGGTCCCCCGAAGTGGTGACCGACGCGGACAGGATATTGACCTTCTCGTCGGCCAGTGCGCGCGTCACATCCGACAGCA
GCCGGTGCCGGTCGAGTGCCTCGACCTGGATTGCCACCAGAAACACCGACGACGGCGACGGCGCCCATAGCACCTCGATG
ATGCGCTCGGCCTGCTGCTGCAGCGATGCGGCGTTGGTGCAGTCGGTGCGGTGCACACTGACCCCGCCGCCACGGGTGAC
GAACCCCATAATCACATCGCCCGGAACCGGCGTGCAGCACTTGGCCAGCTTGGTCAGCACGCCCGGGGCGCCGGGGACGG
AGACCCCGACATCGTCGGTGCTGCGTGGGCGCCGGCATGGTCGCCGGCGTGGACCGCTCGGCGAGTTCCTCTTCCGCC
TGGTCGATACCGCCGAGCTCGGCCAACAACCGCTGCACGACGTGTTTCGCCGACACGTGCCCCTCACCGATGGCGGTATA
GAGTGCTGACACGTCCGCGTAGTGCAGCTCGCGGGCCACCGCCGCCATGGACTCACCATTGACCAAGCGCTGCAACGGAA
GTCCACCGCGGCGCACCTCGCGGGCCATCGCATCCTTACCGGTCTCCAACGCCTCCTCACGCCGCTCCTTGGCGAACCAC
TGGCGGATCTTCGTCTTTGCGCGCGGCGACACCACGAACTGCTGCCAGTCCCGCGACGGCCCGGCGTTCGGCGCCTTGGA
CGTGAAAACCTCGACAACTTCTCCGTTTTCCAGCTTGCGTTCCAGCGCTACCAACCGGCCGTTCACTCGGGCGCCGATGC
AGCGGTGGCCCACCTCTGTGTGCACCGCGTAAGCGAAGTCCACCGGCGTCGAACCGGTTGGCAGCGTGATCACGTCGCCC
TTGGGGGTAAACACGCAAAATCTCTTGCACCGCAAGGTCGTAGCGCAATGATTCCAAGAACTCACCGGGGTCGGCCGCCTC
ACGTTGCCAGTCGAGCAGCTGACGCATCCAGGCCATGTCGTCGATCTCCGCGGCGGCATGCGGATGAAGAACACCGTTGC
GGCCCTTGGCTTCTTTGTAGCGCCAATGCGCGGCGATGCCGTATTCGGCGGTGCGGTGCATGTCGCGGGTACGGATCTGC
ACTTCCAGCGGCTTGCCCTCAGGCCCGACCACAGTGGTGTGCAGTGACTGGTACACACCGTATCTGGGCTGGGCGATGTA
GTCCTTGAACCGACCCGCCATCGGCTGCCATAGCGAATGCACTACGCCGACAGCCGCGTAGCAGTCCCGGATTTCGTCGC
ACAGGATGCGCACACCGACCAGGTCGTGGATGTCGTCGAAGTCGCGGCCCTTAACGATCATCTTCTGGTAGATCGACCAA
TAGTGCTTGGGGCGGCCCTCCACCGTCGCCTTGATCTTCGACGCGGTCAGCGTGTTGACGATTTCGGCACGCACCTTGGC
CAGGTAGGTGTCCCGGGACGGCGCGCAGCCGGCGACCAGCCGGACGATCTCCTCGTACTTCTTGGGATGCAGGATCGCGA
AGGACAGGTCCTCCAACTCCCACTTGACGCTGGCCATGCCCAGCCGATGCGCCAGGGGTGCAATGACTTCCAACGTCTCA
CGGGCCTTGCGGGCCTGCTTCTCCGGCGGCAAGAAGCGCATGGTGCGCATGTTGTGTAACCGGTCAGCCACCTTTATCAC
CAGCACCCGCGGATCGCGGGCCATCGCGGTGATCATCTTGCGAATAGTCTCGCCTTCGGCGGCGCTGCCCAACACCACCC
GATCCAGCTTGGTCACCCCGTCGACGAGATGGCCCACCTCTTCGCCGAATTCCTCGGTCAACGCCTCCAGGGTGTAACCG
GTGTCCTCGACGGTGTCGTGCAGCAGCGCGGCCACCAAAGTGGTGGTGTCCATGCCCAACTCGGCCAGAATGTTGGCAAC
GGCCAACGGGTGGGTGATGTAGGGATCACCGGACTGCCAACTGGCTGGCATGCCTTTGGTCAGCGACCTCGTAGGCTC
GCTGCAAGATCGACAGGTCGGCCTTGGGATAGATCTCCCGGTGCACCGCCACCAACGGCTCGAGCACCGGATTGGTGGTG
CTGCGCTGGGCGGTCATCCGCCGGGCCAATCGGGCCCGCACCCGACGCGACGCGCTGATGCTGGTCTTAAGAGTCTCGAC
CGGCGACTCGGGCGTCTCGAGAGCGGGCTCGAGAGCCGCAGAAGCCTCCGTGGGCGGTGCAACCGCTTGCGCCGTGAGCT
GGTCCTCGGCCACGTTCGTCACCTCCGACCTAGAGGATATCCCTCACAGGCGGCTCAGGCTGTGCACCGGCAGCGGTGCG
AGCGCCGCGCGACCGCTCAACCCCGCAAGTTCCACCACTACGGCCGCCCCGGCCACGTTGGCGCCACCGCGCTCAAGCAG
GCGTCGCGTCGCGCCGATGGTGCCGCCGGTTGCTAACACGTCGTCAATGATCACGACACGGCGGCCCGCAACCTCGATGC
CCTCAGCGAGAATCTCCAGAGTGGCGGCGCCGTACGCCCTGTAGTACTCCTCGCTGAGCACCGGCCGGGGCAGCTTGCCG
CCCTTGCGAACGGCCAGCACACCCACTTCGAGCCGGGTGGCGACCGCGGCTGCCACCAGAAACCCGCGGGCGTCGACGCC
```

FIGURE 6(continued)

```
GGCCACCAGGTCAGCTCCGGACGCCCGATCGGCCAGCGCTTCGGTTACCGCGGCCAATCCTCTTCGGTCGGCGAATAGCG
GGGTGAGGTCCTTGAACTCGACGCCGGGAACCGGAAAGTCGGCCACATCCCGGGTCAGCGACGCAACCACGTCGGCCACA
GATATGGCTGAGCTCCGGCGGGACTCACCGAGCGCGCCAATACCCGCCCGTCGTCGACCCAACGCTGCCGGCGGCGCTTCCC
CCGTGCCTTTAAGGAGAGCCCCGTCGCGATCACGTTCAACACGTAGTCACCAGCCCATGTACCGCCATGGCACACATCCT
CTCCCAGACAGCCCGGAGCACCTGCGACACTACGCTCCGATAGGTCCGCTTCTCGTCGTGGAATTCTGTCAATTACCTGC
AGATGGCACTGGCCATCGTCACCGCGCCAGCGCCCAGCGATCCATGTTCCACCCTGCCCCCCATCGCGTCGGATTCCTGC
TCACCGCATACATTTTCGTCGACATCAACAACGTGCGCTGCTGCCGGTACAACGGCAAGGTTGGCATCTCATCCCAGAGC
ACCGGCGCGGCCTCGGCAAGCAACCTGGCCCGCTCGGCGGGGTCGGCCGACACCGCGAGCGCGCTGATCATGCCGTCGAT
CTGAGCGTTTGCGTACCCCGATAGATTGTTTCCGTTGCCGCTGTGCAAGTCATAGGCATCCATCGCACACGATCCGCTCG
ATCCGCTGCCGGTGGCCCCACCGGTGCTCGCCAACAATACGTCAATCTTTCCGTCCCGCAGCGCTTGCGGTCCGGGTGTG
TCCACCGTCACATCCGAAACGGTGATCCCGGCCGGGGCGCAGGCGTCGGCAATGGTTCCGATGGTGGCCGCCAACCGAGC
GTTGGGCCTGCCGTAGCCGATCCGCACGGTCAGCGGCGTACCACCCAGCGCGTCGCGAGCGGCGGCGGGGTCCACCCGGC
CGAACTGACGTGCTTCGGCGGCGCCGTCGGCATCGGTGAGGGCATCGTCGGTCGCCGGGGACAGCCGCGAGTTGGCAATC
GGAACCCCGGCATCCCGAGCGATCGCGTCCCGGGGTACACACAACGCGAGCGCGCGGCGGGTGCGGCTTTGCGCGAGTGA
ACCTTGTGGTGCGAAGATCAGCTGCTCGATCCCGGCCGACGGGTAGTCGGTGCGCTGGTAGCTGTCGGGGGTTACCAGGG
ATCCCGATGAACCGGCCGCGACGTCGACCACGTCGACGCTGCGGTTGTTGACCCGGTCTTGGATATCGGCTCCCTGCGGC
CAGACGGTGATCCGCTTCGTGATCGCCTTGGTGCCCCACCAACGATCATTGGCGACGAGCACCACGGCGCCATCGTCCAG
GACGGATTCGATCTTGTACGGTCCCGACGAGGGGAAGCGGCTGCGGACTTCGTCGTGGCTGCGGCCCGGCTTGAGGTCCC
ACGTGGAATTCCACAGTCGCGCAATCTGTTCCACCGCTGACACGTTGTTGCTTAGCAACGCCGCGGTAACATCGATGTGC
AGCTGGTCGGCGATCACGTGCGACGGCATCAGCGACGTCGCGGTGAACAGCTGGGAGTGGTCAACGACACTGCGATCCGG
GATGAACGACACCCGGGCCTTTTTCTGCCCCGCCGTGCACTCGATGTTGGCGATGTCGACATAGCCGGCCTGCGTAGCAG
CGTCGAAGCCGGGAAAGCGGCCGGATTGTGCCGCCCAGGCCAATACCAGGTCGTCACAGGTCACCGGCCTGCCGTCGGAA
TAGACGGCGTCGTCGGAGATCTGGTAGTCGAGGATCAACGGCGACCCCTCCACCACCGAGACCGTTCCGAAGTCGCGGTC
AGCCACCACTTGGCCGTCGGGGCCGTGATAGCCAAACCCGGTGAGAGTCCGGGCGAATGCCTGCGCCCCGGCCGACGCGG
CACCGATGACGGTATTGGTGTTGTAGGTGACCAGCGCGCCGTCGACCACGTAGTCGATCTGAGCCGCGGCGCTGCCCGAA
CACGCGGTCAGCGTGGTTGCGGCGACCAACGTCGCGGTACCAACGACTCGCAGGCCGGCGATGCGCGTATGACGCCGGCG
GCGGGGGGCCACCGCGCCTACCGCCGACCGGCGTTCCGCTTGCCGGTCGGACGCCTGGTACCGACGGGACGCACTGGGCG
CGCCCCCGGCGCCGGCTTGCTGGAGCCCTGGGCCGCCCGCGGGCGGATTGGCTGCTGGCCTGCGTGATCCCCACCAGCG
ACTGTTCATCAGCGGCTGCCGGCTGCTCGCCGCCATCCGTGCTGGCGTCCTCTGATCCCGCCGGCGAGCCGGAGTTACGC
CGTTTGAGCACCCGACGGGTGTGGTTGCGCACCAACTCCGTGCGCTCACGGAGGGTAACCAACAGCGGCGTGGCGAAGAA
GATTGACGAGTAGGTGCCGATGATGATGCCGATCAGCTGCACCAGCGCCAGGTCTTTGAGAGTGCCGACGCCCAGCAGCC
AGACCGCCACCACCATCAGCGCCAACACCGGCAACACGCCGATCAGGCTGGTGTTGATCGACCGCATGAACGTCTGGTTG
ATCGCCAGGTTGGCCTGCTCGGCGAAGGTGCGCCGGGTGGTGTGCTGGAAGCCATGGGTGTTCTCCTCGACCTTGTCGAA
CACGATGACGGTGTCATAGAGCGAGAACCCGAGAATGGTCAGCAGGCCGATGACCGTGGCCGGGGTGACTTCGAAACCCA
CCAGGGAATACACGCCGGCGGTGACGGTCAGGTCGAAGAGCATGGCCGTTATCGCCGAGATGGTCATGTAGCGCTCGTAG
CGCACGGTAATGTAGAGGGCGACCAGCACCAGAAACACCACCAGCGCGATCACCGCCTTCTTGGTGATCTGACCGCCCCA
GGTCTCCGACACCGCCGAGTCGCTGATGGCCTGCTTGCTGGGCTGACCGTCGGTTCCCTTGGGCCCGAAGGCCTCGAATA
GGGCGTCCCGCAGCTTGGCCGTCTGGTCGCTGGTCAGCGTCTCCGAACGAATCTGCACCGTCGCCGAAGCACCGGCCCCG
ACGATCACCACCGACTGGGGCTCACTGCCGAGGGCCCGGTAGTAGACGTCTTCGACCTGCGCGACTTGGGTGCTGCCACG
CGGGAACGACACCGTGGTACCGCCTTTGAAATCGATGCCGAAGGTGAACCCACGAAAGACGATGCTGGCGATGGCCACCG
CGACGATCGCACCGCTCACGCCAAACCACAACCGGCGGCGTCCCACTACCTCAAACGCCCCGGTGCCGGTGTACAGGCGC
GAAAGGAAGCTATGGTGCCCCAGCTTCGAGGCGGTGTCTGTGGTGCTGTCGCCGTCGGTCCGCGCCACAGCACTCTCGGT
GGCCTCGGTGAGTTCGACCGCCGACGTGGCTTCGTCGTCGCGGCCGGTCTTTGCTTTCGACGCCATCGGCTATCCCCGTC
CCGTCCGAGCCATGGCCCGGCGTTCGCGTGCGACCTGCTGCACCGCTCCCAGGCCGTTGTATGCCGGCTTGGCCAGCAGC
GACGATTTGGACGCCAGATACACCAACGGCCACGTCACCAAGAACACCACGACGAGGTCCAGGATCGTGGTGAGGCCCAG
GGTGAACGCGAACCCCTTCACCTGACCGATCGCCAGAAAGTACAGCACGGCAGCGGCCAGGAAAGTGACGGCGTTGCCCG
ACACGATCGTCTTGCGGGCACGCGCCCAACCGCGCGGCACTGCCGACCGGAACGAACGGCCTTCGCGGATCTCGTCTTTG
ATGCGTTCGAAGAACACCACGAACGAGTCGGCGGTGGTCCCGATACCGATGATCAGGCCCGCAATACCAGCCAGATCTAG
GGTGTAGTTGATATATCGGCCCAAGAGCACCAGGATCGCAAAAACCATTGAGCCAGAAGCCACTAGCGACAAGGCCGTGA
GCAGTCCCAGCACTCGGTAGTAGAGCAGCGAATACACCAGCACCAACAGCAGGCCGATCGCACCCGCGATCATGCCCGCG
CGCAGCGATGACAACCCCAAGGTCGCCGAAACCGTTTGGGCTTCCGACGGTTCGAAGGACAGCGGCAGCGACCCGTACTT
GAGGACGTTGGCGAGCTGGCGTGCGGTCGCCGCGGTGAATGGCGGATCCCCACCGCTGATCTGGGTTCGGCCGCCGGGGA
TCGCTTCCTGGATCTGCGGTGCACTGACAACCTGCGAGTCCAGGGTGAACGCCGTCTGGGTGCCGATATGGGCGGCGGTG
TAGTCGGCCCAGATGTTGGCCGCCGGACCCTTGAACTGCAGGTCGACGACGTAGCCGATGCCGCGCTGGTCCATACCCGA
GGTGCCGTTTTGGATCTGGTCGCCGCTGATGATCGACGGCGCCAGCAGGTACGCGGTCTTGTGGTCGGTCGAGCAGGTCA
CCAACGGCAGTTTCGGGTCGTCGTTGCCGGCCAAAATGTCGTCGCTCTCGCAGCGGGTCGCCTGGAATTGCAGTGCAACC
```

FIGURE 6(continued)

```
ATCTGCATGTATTGGTTGGTGCTCTGCCGCAGCTTCTTCTCCTGGGCGATGCGCTCGGCGAGATCCTTGCGCGGATCCGT
GGCCGGCGCCTCAGCGGGCGGCGCCGGCGGCGGGCTGGCCGGTGAGGTCGGGTTGGGCGATGGCGCCGGGTCCTGCGGAT
AGGGCCGCGGTTGGGCCCCAGGTTGCGGTGAAGCCGGCGCCCCGATTGGGCTGGCGGCGGTGCGGCGGGTTGACCGGGC
GGCTGCGGTTCGGCGCTGGGTGCCGGCTGCGGTTCTTCGGCTGCGGGCTGCGCCGGCATCGAGTTGAGCACCGGCCGGAT
GTACAGCCGAGCGGTCTGTCCGAGGTTGCGTGCCTCGCTGCCGTCGTTGCCGGGCACCGTGATGACCAGGTTGTCACCGT
CGACGACCACCTCCGACCCGGACACTCCCAGCCCGTTGACCCGCGCGCTGATGATTTGCTGCGCCTGTGCCAGCGCTTCC
CGGCTCGGGGCCGAGCCGTCCGGTGTGCGCGCGGTCAGCGTGACCCTGGTGCCGCCCTGCAGGTCAATGCCGAGTTTGGG
GGCGGTGTGCTTGTCCCCGGTGAAAAACACCAGCAAATAGATGCCGATCAGCATCACCAGGAACACCGACAGGTAACGGG
CAGGGTGCACCGGCGCCGAAGACGATGCCACGTTCCTTGTATCTCCTCGAGAATCAGTTTTCTACCCCCGACAGAGCCTA
CGTGTCGCGCCGGGGCGCGTCGCGCAAGCGGCTCGTCGGTTCCGGTCGGCCGGTTGCCGGTCAGGAATCGTTGGTCACCC
GGCGCTCGCCGGCCACGTCGTCAACATCCTTGTCAAGGTCCTCGCTTGAGCTCCTCGTCGATGTCGTCGTCCGGCAGAATT
CGGTCACGAATCGCCAACTTCATCCACGTGGTGACCACCCCGGGCGCGATCTCGAGGTCGATGGTGTCGTCGGCAATGGC
GACGATGGTGGCTTCCAGCCCAGAAGTCGTGTGTACCCGCTCCCCGGGCTGCAACGAGTCGTGCAGATCGATGGTGGCTT
GCATGGCCCGTCGCTGGCGGCGCGACGCGAAGTACATGAACCCACCCATGATGAGCAGGAACGGCAAGAACAAAACGAAA
CTCTCCATCAACCCGTCTTTCGTATTGGTATTGCGATCACGGTGCCAGGCCTACCCGCGGGCCGCGCACCTGGTAACAGT
CCAGTGTGCCCGTCCAGTCTGGCAGGCCGGAAACATCGGTCAGCAGATAGGCTTTACCAGCGATGTGAACCGGCGAGCCG
GGTGAGGAGGATCTGTGGCCAGCCTGCAGCAGAGTCGGCGCCTGGTCACCGAAATCCCCGGTCCCGCATCGCAGGCACTG
ACTCACCGCCGGGCGGCGGCGGTGTCCAGCGGTGTTGGGGTCACCCTGCCGGTGTTCGTAGCCCGCGCCGGCGGCGGCAT
CGTGGAAGACGTGGACGGTAACCGGCTCATCGACCTGGGTTCGGGCATCGCAGTGACGACGATCGGCAACTCGTCGCCAC
GCGTGGTGGATGCGGTGCGCACGCAGGTGGCCGAATTTACCCACACCTGCTTCATGGTGACGCCATACGAGGGGTACGTG
GCCGTCGCCGAGCAACTCAACCGGATTACCCCAGGTTCGGGCCCCAAGCGCTCGGTGTTGTTCAATTCCGGCGCCGAGGC
AGTCGAGAACGCCGTCAAGATCGCACGCTCCTACACCGGCAAGCCCGCGGTGGTGGCGTTCGACCACGCCTACCACGGTC
GCACCAACCCTAACGATGGCGCTGACCGCCAAGTCGATGCCCTACAAGAGCGGCTTCGGTCCGTTCGCGCCGGAGATCTAC
CGAGCGCCATTGTCTTACCCCTATCGGGACGGCCTCCTCGATAAGCAACTGGCTACCAATGGTGAGCTAGCCGCGGCCCG
AGCCATCGGCGTCATCGACAAGCAGGTAGGCGCGAACAACCTGGCCGCCCTCGTCATCGAACCGATCCAGGGCGAAGGCG
GTTTCATCGTTCCGGCCGAAGGGTTCCTACCTGCCCTCCTCGATTGGTGCCGCAAGAACCATGTGGTGTTCATCGCCGAC
GAGGTGCAAACCGGCTTTGCCCGTACCGGGGCGATGTTCGCCTGCGAGCACGAGGGCCCCGACGGTCTAGAGCCCGACCT
GATCTGCACGGCCAAAGGCATCGCCGATGGATTGCCGCTGTCGGCGGTCACCGGCCGCGCCGAGATCATGAACGCCCCGC
ACGTGGGCGGCCTGGGCGGCACGTTCGGCGGCAACCCGGTGGCCTGTCGGGCCGCGCTGGCCACCATCGCAACCATCGAA
AGCGACGGGCTGATCGAGCGGGCCCGCCAGATCGAACGCCTGGTGACCGACCGGTTGACGACGCTGCAGGCCGTCGACGA
CCGGATCGGCGACGTGCGTGGTCGCGGCGCCATGATCGCCGTAGAGCTGGTCAAATCCGGAACCACCGAGCCCGACGCCG
GGCTGACCGAGCGGCTGGCGACCGCGGCCCACGCCGCCGGCGTCATCATTTTGACCTGCGGCATGTTCGGCAACATCATC
CGGCTACTGCCGCCGCTGACCATCGGCGACGAGCTGCTGAGTGAGGGCTGGACATCGTGTGCGCGATCTTGGCCGACCT
CTGACGGCCTGCCGGCCCCGACTGCGTCATCCCGTGCCGCATCTCACAGCCGATCAGCAGCAGGCTTGCATTGTGTAATA
TATTTACTTTAGCTAACGTTCTATTGGTCGGGCGCAGCGCCGCGCCGTCGATTTCCCACCCTTTCCGGCACGCCGAGGTG
ACCGCATGTCGATCAACGATCAGCGACTGACACGCGCGTCGAGGACCTATACGCCAGCGACGCCCAGTTCGCCGCCGCC
AGTCCCAACGAGGCGATCACCCAGGCGATCGACCAGCCCGGGGTCGCGCTTCCACAGCTCATCCGTATGGTCATGGAGGG
CTACGCCGATCGGCCGGCACTCGGCCAGCGTGCGCTCCGCTTCGTCACCGACCCCGACAGCGGCCGCACCATGGTCGAGC
TACTGCCGCGGTTCGAGACCATCACCTACCGCGAACTGTGGGCCCGCGCCGGCACATTGGCCACCGCGTTGAGCGCTGAG
CCCGCGATCCGGCCGGGCGACCGGGTTTGCGTGCTGGGCTTCAACAGCGTCGACTACACAACCATCGACATCGCGCTGAT
CCGGTTGGGCGCCGTGTCGGTTCCACTGCAGACCAGTGCGCCGGTCACCGGGTTGCGCCCGATCGTCACCGAGACCGAGC
CGACGATGATCGCCACCAGCATCGACAATCTTGGCGACGCCGTCGAAGTGCTGGCCGGTCACGCCCCGGCCCGGCTGGTC
GTATTCGATTACCACGGCAAGGTTGACACCCACCGCGAGGCCGTCGAAGCCGCCCGAGCTCGGTTGGCCGGCTCGGTGAC
CATCGACACACTTGCCGAACTGATCGAACGCGGCAGGGCGCTGCCGGCCACACCCATTGCCGACAGCGCCGACGACGCGC
TGGCGCTGCTGATTTACACCTCGGGTAGTACCGGCGCACCCAAAGGCGCCATGTATCGCGAGAGCCAGGTGATGAGCTTC
TGGCGCAAGTCGAGTGGCTGGTTCGAGCCGAGCGGTTACCCCTCGATCACGCTGAACTTCATGCCGATGAGCCACGTCGG
GGGCCGTCAGGTGCTCTACGGGACGCTTTCCAACGGCGGTACCGCCTACTTCGTCGCCAAGAGCGACCTGTCGACGCTGT
TCGAGGACCTCGCCCTGGTGCCGGCCCACAGAATTGTGCTTCGTGCCGCGCATCTGGGACATGGTGTTCGCAGAGTTCCAC
AGCGAGGTCGACCGCCGCTTGGTGGACGGCGCCGATCGAGCGGCGCTGGAAGCGCAGGTGAAGGCCGAGCTGCGGGAGAA
CGTGCTCGGCGGACGGTTTGTCATGGCGCTGACCGGTTCCGCGCCGATCTCCGCTGAGATGACGGCGTGGGTCGAGTCCC
TGCTGGCCGACGTGCATTTGGTGGAGGGTTACGGCTCCACCGAGGCCGGGATGGTCCTGAACGACGGCATGGTGCGGCGC
CCCGCGGTGATCGACTACAAGCTGGTCGACGTGCCCGAGCTGGGCTACTTCGGCACCGATCAGCCCTACCCCCGGGGCGA
GCTGCTGGTCAAGACGCAAACCATGTTCCCCGGCTACTACCAGCGCCCGGATGTCACCGCCGAGGTGTTCGACCCCGACG
GCTTCTACCGGACCGGGGACATCATGGCCAAAGTAGGCCCCGACCAGTTCGTCTACCTCGACCGCCGCAACAACGTGCTA
AAGCTCTCCCAGGGCGAGTTCATCGCCGTGTCGAAGCTCGAGGCGGTGTTCGGCGACAGCCCGCTGGTCCGACAGATCTT
CATCTACGGCAACAGTGCCCGGGCCTACCCCGCTGGCGGTGGTTGTCCCGTCCGGGGACGCGCTTTCTCGCCATGGCATCG
```

FIGURE 6(continued)

```
AGAATCTCAAGCCCGTGATCAGCGAGTCCCTGCAGGAGGTAGCGAGGGCGGCCGGCCTGCAATCCTACGAGATTCCACGC
GACTTCATCATCGAAACCACGCCGTTCACCCTGGAGAACGGCCTGCTCACCGGCATCCGCAAGCTGGCACGCCCGCAGTT
GAAGAAGTTCTATGGCGAACGTCTCGAGCGGCTCTATACCGAGCTGGCCGATAGCCAATCCAACGAGCTGCGCGAGCTGC
GGCAAAGCGGTCCCGATGCGCCGGTGCTTCCGACGCTGTGCCGTGCCGCGGCTGCGTTGCTGGGCTCTACCGCTGCGGAT
GTGCGGCCGGACGCGCACTTCGCCGACCTGGGTGGTGACTCGCTCTCGGCGCTGTCGTTGGCCAACCTGCTGCACGAGAT
CTTCGGCGTCGACGTGCCGGTGGGTGTCATTGTCAGCCCGGCAAGCGACCTGCGGGCCCTGGCCGACCACATCGAAGCAG
CGCGCACCGGCGTCAGGCGACCCAGCTTCGCCTCGATACACGGTCGCTCCGCGACGGAAGTGCACGCCAGCGACCTCACG
CTGGACAAGTTCATCGACGCTGCCACCCTGGCCGCAGCCCCGAACCTGCCGGCACCGAGCGCCCAAGTGCGCACCGTACT
GCTGACCGGCGCCACCGGCTTTTTGGGTCGCTACCTGGCGCTGGAATGGCTCGACCGCATGGACCTGGTCAACGGCAAGC
TGATCTGCCTGGTCCGCGCCAGATCCGACGAGGAAGCACAAGCCCGGCTGGACGCGACGTTCGATAGCGGCGACCCGTAT
TTGGTGCGGCACTACCGCGAATTGGGCGCCGGCCGCCTCGAGGTGCTCGCCGGCGACAAGGGCGAGGCCGACCTGGGCCT
GGACCGGGTCACCTGGCAGCGGCTAGCCGACACGGTGGACCTGATCGTGGACCCCGCGGCCCTGGTCAACCACGTGCTGC
CGTATAGCCAGCTGTTCGGCCCAAACGCGGCGGGCACCGCCGAGTTGCTTCGGCTGGCGCTGACCGGCAAGCGCAAGCCA
TACATCTACACCTCGACGATCGCCGTGGGCGAGCAGATCCCGCCGGAGGCGTTCACCGAGGACGCCGACATCCGGGCCAT
CAGCCCGACCCGCAGGATCGACGACAGCTACGCCAACGCTACGCCGAACAGCAAGTGGGCCGGCGAGGTGCTGCTGCGCG
AAGCTCACGAGCAGTGCGGCCTGCCGGTGACGGTCTTCCGCTGCGACATGATCCTGGCCGACACCAGCTATACCGGTCAG
CTCAACCTGCCGGACATGTTCACCCGGCTGATGCTGAGCCTGGCCGCTACCGGCATCGCACCCGGTTCGTTCTATGAGCT
GGATGCGCACGGCAATCGGCAACGCGCCCACTATGACGGCTTGCCGGTCGAATTCGTCGCAGAAGCCATTTGCACCCTTG
GGACACATAGCCCGGACCGTTTTGTCACCTACCACGTGATGAACCCCTACGACGACGGCATCGGGCTGGACGAGTTCGTC
GACTGGCTCAACTCCCCAACTAGCGGGTCCGGTTGCACGATCCAGCGGATCGCCGACTACGGCGAGTGGCTGCAGCGGTT
CGAGACTTCGCTGCGTGCCTTGCCGGATCGCCAGCGCCACGCCTCGCTGCTGCCCTTGCTGCACAACTACCGAGAGCCTG
CAAAGCCGATATGCGGGTCAATCGCGCCCCACCGACCAGTTCGCGCTGCCGTCCAAGAAGCGAAAATCGGTCCGGACAAA
GACATTCCGCACCTCACGGCGGCGATCATCGCGAAGTACATCAGCAACCTGCGACTGCTCGGGCTGCTGTGATCGGGCCT
GGCCGCCGCGGCGCCGGGTAACCAAGCAGCCCGTTACGCCCAGTTCGCCTATGAGAAGGCAGTAAGAAGCGCGAAAAATG
GCAGACCCCGACGGAGGCCCTCTGAAAGAGTCTTGATCATCAGGGCGCGTGACATGTGTCACATGACGGGTTGGGAGGGT
GGCTGATGTCGTTTGTCACGGCAGCTCCAGAGATGCTGGCGACGGCGGCGCAGAATGTCGCGAATATCGGCACATCGCTG
AGTGCGGCAAACGCGACGGCAGCGGCGTCCACGACCTCGGTGCTGGCGGCCGGAGCCGACGAGGTATCGCAGGCTATCGC
AAGGCTGTTCAGTGATTACCGCCACGCACTATCAGTCGCTGAACGCTCAAGCCGCGGCATTTCATCACAGCTTCGTGCAAA
CGTTGAACGCCGCCGGTGGCGCCTATTCGAGCGCCGAGGCGGCCAACGCTTCGGCGCAGGCGTTGGAACAGAATCTGTTG
GCCGTGATCAATGCGCCCGCCCAGGCGTTGTTCGGCGTCCCCTGATCGGCAATGGCGCGAATGGAACAGCGGCCAGCCC
CAACGGCGGTGATGGTGGGATTTTGTACGGCAACGGCGGCAACGGCTTCTCCCAAACGACCGCCGGGGTGGCCGGCGGCG
CCGGTGGTTCCGCGGGCCTGATCGGCAACGGCGGCAATGGTGGCGCCGGTGGGGCCGGTGCTGCCGGCGGGGCCGGCGGC
GCCGGCGGATGGCTGCTCGGCAACGGTGGCGCCGGCGGTCCCGGCGGCCCAACGGACGTTCCTGCCGGCACAGGTGGAGC
CGGCGGGGCCGGCGGCGACGCCCCATTGATCGGCTGGGGCGGCAACGGCGGGCCCGGCGGTTTCGCTGCTTTTGGAAACG
GTGGGGCCGGCGGCAACGGCGGCGCCAGCGGTTCGCTCTTTGGCGTCGGCGGCGCCGGCGGCGTCGGCGGATCGAGCGAA
GACGTCGGCGGCACCGGCGGGGCCGGCGGCGCTGGCCGCGGTCTATTCCTTGGCCTGGGCGGTGATGGCGGCGCCGGCGG
CACCAGCAACAACAACGGCCGTGACGGTGGCGCCGGCGGCACCGCGGGAGGTCGATTGTTCAGCCTGGGCGGTGACGGTG
GCAACGGTGGTGCCGGTACCGCAATCGGATCCAACGCCGGTGACGGTGGCGCCGGCGGTGACAGCAGCGCCCTGATCGGC
TACGCCCAGGGCGGCTCCGGCGGCCTCGGCGGCTTCGGCGAAAGTACCGGCGGCGACGGCGGCCTGGGCGGCGCCGGCGC
TGTGCTCATCGGCACGGGCGTCGGCGGTTTCGGCGGCCTCGGTGGCGGCTCCAACGGCACCGGGGGCGCGGGCGGCGCGG
GCCGGCACGGGCGCCACGCTGATCGGCCTGGGCGCCGGCGGCGGCGGCATCGCGGGTTCGCCGTCAACGTGGGCAAC
GGCGTCGGCGGTCTGGGCGGCCAGGGCGGCCAGGGCGCCGCGCTGATCGGCCTGGGCGCCGGCGGTGCCGGCGGTGCCGG
CGGCGCCACAGTCGTTGGACTTGGTGGCAATGGCGGTGACGGCGGTGACGGTGGCGGCCTGTTTAGTATCGGCGTCGGTG
GGGACGGCGGCAACGCCGGCAACGGCGCCATGCCTGCCAATGGCGGCAACGGCGGCAACGCCGGGGTCATTGCCAACGGC
TCCTTTGCCCCGTCGTTCGTCGGCTTCGGCGGCAACGGCGGCAACGGCGTCAATGGCGGCACCGGCGGCAGCGGCGGGAT
CCTTTTTGGCGCCAACGGCGCGAACGGACCGTCGTAGCGGGTCCTCCAGCGCACTACTCGAACAACCCCGGTTGACTCGC
TCCGACCGGTGGCGTCATGCCCAGGTGCGTCCAGGCCAGGGCGGTGGCCACCCGGCCGCGCGGGGTGCGCGCGACCATAC
CCGCGCGCACCAGAAATGGTTCGCACACATCCTTCGACCGTGGCGGCCTCCTCCCCGACCGCCACCGCCAGCGTCGACACA
CCCACTGGACCACCGCCGAAGCTGCGGGTCAGCGCCGAGAGCACCGCTCGGTCCAGCCGGTCCAGACCCAGCTCGTCGAC
GTCGTAGACCTCCAGTGCGGCCTTGGCGACGTCGCGGGTGATGACGCCGTCGGCGCGCACCTCGGCGAAGTCACGCACCC
GGCGCAACAACCGGTTGGCGATCCGCGGCGTTCCCGAGAACGGCGGGCGATTTCGGCGCCGGCGTCGGCGCCCAGCTCG
ATACCCAGAATTCCGGCGGAGCGGGCCAGCACCCGCTCCAGCTCGGCGGGCTCGTAGAAĀTCCATGTGCGCGGTGAAGCC
GAACCGGTCGCGCAGCGGGCCGGTCAACGCGCCCGACCGGGTAGTCGCCCCGACCAGGGTGAACGGCGCGACCTCCAGCG
GAATCGACGTGGCCCCAGGACCTTTGCCGACCACCACATCGACGCGGAAGTCTTCCATCGCCAGATACAGCATCTCCTCG
GCGGGCCGGGCGATGCGGTGGATCTCGTCGATAAACAACACGTCGTGCTCGACCAGGTTGGACAGCATCGCCGCCAGGTC
ACCGGCGCGTTCCAACGCCGGCCCCGACGTCACCCGCAGCGAGGACCCCAGCTCGGCGGCGATGATCATCGCCAACGACG
```

FIGURE 6(continued)

```
TCTTGCCCAAGCCCGGCGGACCGGACAGCAGAATGTGATCCGGTGTGCCGCCGCGGTTTTTGGCTCCCTCGATGACCAGC
TGCAGCTGTTCGCGGACCCGGGGCTGGCCGATGAATTCGCGTAACGAGCGCGGCCGCAGGCTGACGTCGATGTCGCCCTC
TCCGACGGTGAGTGCGGGCGAAACGTCGCGGTCGGACCGCTCGGTCATCGGGCCTTCCCCAGCAACGACAAGGCAGACCG
CAGCGCGCTGGATGTCGTCGCGTCATGGTTGGCGGCCAGCACCGTATCGGTGGCCTCCTCGGCCTGTTTGGCCGCAAAGC
CCAGGCCGACCAGAGCCTCGACCACGGACTGCGCACCGCGTGGCCGTTGGTCGAGAGTGCGCCGCCGGTGGCTGCCACC
CCAACCTTGTCGCGTAGTTCCAACACCATGCGTTCGGCGCCCCGCTTGCCGATCCCAGGCACCCGGGTCAGGGCGGCGAC
GTTGCCGTCGGCCAGCACCTGCCGTAGCGCCGGAGCGTCGTGCACGGCCAGTGCCGCCATCGCCAGCCGGGGCCCAACGC
CGGAGACCGACAGCAGCGTCAGGAATAGGTCGCGGGTTTCCCCGTCGGGAAACCCGTACAGCGTCATCGAGTCCTCGCGC
ACAATCATCGCGGTGATCAGCCGGGCCTCGGTGCCTTGCCGCAACGTCGCCAGCGTCGCCGGTGTCGCGTTCACTCGGTA
GCCCACACCGGCGGCCTCGATCACCACATGGTCAAGCGCCACCTCGAGCACCTCACCGCGGACCGAGGCGATCATCGGGC
GGCCTTCAGCTTGGCTAGGTACGCATGACGCTGCTGCGCTGCTCGTGCTTCCGCCCTCGACGTGGCCTCAGCCATCCGGG
CGATCGTCGGCGCCCGCCAACAGTGACAGATCGCCAGCGCCAAAGCGTCGGCCGCGTCGGCCGGTGTCGGTTTAGCTTGC
AGCGCAAGGATTTTGGTGACCATCGCGGTGACCTGAGCCTTGTCTGCGGAACCGTTGCCAGTGACCGCCGCCTTGACCTC
GCTGGGGGTATGGAAATGCACGTCGACACCACGTTTGGCCGCCGCCAGGGCGATCACGCCGCCGGCCTGCGCGGTGCCCA
TCACCGTGGTCACGTTGAGCTGAGAGAACACCCGTTCGATAGCCACCACCTCCGGATGATGGGTGTCCAGCCAGTGCTCG
ACGGCATCGCTGATGGCCAACAGGCGCTGCGCCAAGGCCGCATCCGACGGTGTGCGCACCACGTCGACATCCAGCGCGGT
GAGCTGCCGACCACGCCCACTCTCGATAAGCGACAGCCCGCATCGGGTCAACCCGGGATCGACACCCATCACCCGCACCG
CACGCTCCCTCAGCCATTTCCGAACAATCGTTCGATACGCTAGCGGATCGTCCCCGACATCCCGCCAGGACACGCCTATG
GAACGTGCGATGGTAAATTTCCTACCATGCGAACAACCATCGATGTCGCAGGACGTCTGGTGATTCCCAAGCGGATTCGC
GAGCGCCTTGGCTTGCGCGGGAACGACCAGGTGGAGATCACCGAGCGCGATGGGCGCATCGAGATTGAGCCGGCCCCGAC
CGGTGTCGAACTCGTTCGGGAAGGCTCGGTTCTCGTCGCACGGCCAGAACGTCCCCTGCCCCCGTTGACCGACGAAATCG
TTCGGGAAACGCTCGATCGCACACGGCGGTGATCGCACCAGACACCAGCGTGCTGGTTGCCGGATTCGCGACCTGGCACG
AAGGGCACGAGGCCGCCGTGCGCGCGCTCAACCGTGGCGTCCATCTGATCGCGCACGCGGCTGTGGAAACCTATTCGGTC
TTGACCCGGCTACCACCGCCGCATCGTATTGCCCCTGTTGCCGTCCACGCCTACTTGGCGGACATCACCTCCAGCAACTA
CCTGGCACTGGATGCCTGCTCATATCGCGGCTTGACCGACCACCTCGCCGAGCACGATGTCACCGGTGGCGCAACCTACG
ATGCCCTGGTCGGCTTCACGGCGAAAGCTGCCGGCGCAAAGCTGCTGACTCGCGACCTGCGCGCGGTCGAAACGTACGAG
CGATTGCGGGTCGAGGTTGAGCTGGTGACCTGAGAAACCGTTGCCGTTGAGTGTGTTTGAGTTGCACGCTCACCGACACC
CGGATGGTGCACCAGTGAGCTGGGGTGACCGCGGCCGAGACCTGCCGGGTTCCCGGCCGGACAACTCGCCCGTTGTGACC
CCCGGTCCGCGAAAGCTGTTACGTTAAACGGCGCCATCGATATGCGACCGATCGACCAACCGCGGCGCAGCGGTACGAG
AGGGTATGCGTGGGAAATCTGCTGGTCGTGATTGCCGTGGCGCTGTTCATCGCCGCCATCGTCGTTCTCGTCGTGGCCAT
CCGGCGGCCCAAAACACCAGCCACGCCGGGCGGGCGCCGGGATCCGCTGGCCTTCGACGCAATGCCGCAATTCGGCCCCC
GCCAACTCGGACCCGGCGCAATTGTCAGCCACGGTGGCATCGACTATGTGGTCCGCGGATCAGTCACCTTTCGCGAGGGT
CCCTTCGTGTGGTGGGAACACTTGCTGGAAGGCGGCGACACGCCAACCTGGCTGAGCGTGCAAGAGGACGACGGGCGTCT
CGAGCTTGCGATGTGGGTGAAACGCACCGATCTGGGCTTGCAGCCCGGTGGCCAGCACGTGATCGACGGCGTGACGTTTC
AGGAGACCGAGCGCGGTCACGCCGGATATACCACCGAGGGCACGACGGGCCTGCCGGCCGGCGGTGAGATGGACTACGTC
GACTGCGCCAGTGCCGGTCAGGGGGCCGACGAGTCCATGCTGCTGTCATTCGAGCGCTGGGCACCGGACATGGGATGGA
GATAGCGACCGGCAAGTCCGTACTGGCCGGCGAGCTCACCGTCTACCCCGCCCCCAGTCTCGGCATAGGGCCGAATCG
GTGCCACTTCATCAGCTCGCCATAGCCCGGTGGACGTATCAGGGGCATTGCTTGGACTCGTGCTGAACGCACCCGCGCC
GCGGCCACTGGCCACCCACCGACTGGCCCACACCGACGGCAGCGCACTGCAGCTCGGCGTCCTCGGCGCGTCGCATGTCG
TCACCGTCGAGGGACGCTTCTGCAGGAAGTCTCCTGCGTGGCCCGCAGCCGGGCGGCGATCTGCCCGAGTCCACCCAC
GCACCCGGCTACCACCTCCAATCCCATACCGAGACGCACGACGAGGCGGCGTTTCGGCGACTCGCGCGCCACCTGCGTGA
ACGCTGCACGCGGGCAACCGGGTGGCTGGGCGGTGTGTTTCCCGGTGATGACGCCGCGCTGACCGCACTCGCCGCCGAAC
CCGATGGAACCGGGTGGCGTTGGCGGACTTGGCATCTGTACCCGAGCGCGTCCGGCGGGACGGTGGTCCACACGACGAGC
CGATGGCGTCCATGACCGCAACCGCCTGTTCCTGGTTGCCGGCAGCTTGGCGGTTGCCGCCGCCGTGTCCTTGATCTCT
GGAATCACGCTGCTGAACAGGGACGTTGGCTCGTATATCGCCTCGCACTATCGCCAAGAATCCCGTGACGTGAACGGAAC
GCGATACCTGTGCACCGGATCGCCCAAACAGGTGGCCACCACGCTCGTCAAGTACCAGACCCCGGCGGCGCGCGCGTCGC
ATACCGACACCGAGTACCTGCGTTACCGCAACAACATCGTGACGGTCGGACCCGACGGCACCTATCCGTGCATCATCCGC
GTCGAAAACCTCAGCGCCGGATATAACCACGGCGCATATGTCTTCCTGGGCCCTGGATTCACCCCTGGGTCCCCGTCGGG
CGGTTCGGGGGGCAGCCCGGGCGGTCCTGGCGGCAGCAAGTAAGGCGATGACGCAAAGGAGAGAGTCATGTATTAGGCCG
GAGTCGATTTCGGGACCATCAGCCTTTACCCCGATCCTGCATGGGGTGGTGGCCACCGTCTTGTACTTCCTAGTGGGCGG
GCCGTGCTAGTCGCAGGCTTTCTGATGGTCAACCTGTTGACCCCGGGCGATCTGCGTCGCCTAGTGTTCATCGACCGCCG
CCCCAACGCCGTGGTTCTGGCCGCCACAATGTATGTGGCGCTGGCCATCGTCACCATCGCCGCCATCTACGCCAGCTCCA
ATCAGCTGGCCCAGGGCCTGATCGGCGTGGCGGTGTACGGAATCGTCGGTGTCGCGCTGCAGGGGGTGGCACTGGTGATC
CTCGAGATCGCGGTGCCGGGGCGATTCCGTGAGCACATCGACGCACCTGCGCTGCATCCGGCGGTGTTCGCTACCGCCGT
CATGCTGCTGGCGGTAGCGGGGGTAATCGCCGCCGCGTTGTCATGACGTCCACCCGGCAGGCGGGCGAAGCCACCGA
```

FIGURE 6(continued)

```
AAGCTTTGCGGACTTGCTCGACCGACATTGCGTGCCATTCATGAGCGGGTGCCGGTCGCGGTGCTTGCGCGTCGACGACC
TTGCGTGCCAGCAGGTATCCCGAGAGCAGTCCGGCCGCCGCGCCGGTGGTCACCGGGCCGGGCCCCAGTCCGCGGACCCC
TGGCAGCATCAACAGGGCTCCCAAAGCCGATGCACCACCGGAAATTTCGTTACCTCGCTGGCGTGCGGCCCTGGCCGCCG
GAATCGCGTGCAGCACCCTCCAGGCGGCTCCAAGATCGGGCAGCAGGACATCTGCGTACCAGGGCGGTGCACCGGCTCCA
GGTGGTGGCAGCACACCAAGCGCCACATCGGCAGCCGAAAGCGCTTGCTTACCAACCGATGACAACACCGCGACGGTGCG
GCCCGCCTGGCGCAGCTCGGCCACCGCACGGGCTAGGGCTTCGTCGAGGGACCCGCTGGCACCGTCGTCGAGGGGCCGGA
TGTCGTCGAACACCGGTCGCAACTCGCCCAGGGCGTCGACATCGACCGAAACCAGGTCCGCCCCGGTGCGATGTGCCTCG
GCAACCACCGCGGAGGCCAGCCGGTCGTGCATGGGGCGGAAAAGTGCCTCGACTGCCGAATCCGAACCGCTGGCCGAGAC
ACCGGGTACTCGGTGCCAGCCTGGGCGCAGGCCACTCTCCGTCAAAACGAGTTGCGCCCGATTCCACGCTGTGGACAGCT
CGTCTGCGCCGCAACCGCGGATGCGCGCCACGCGCAGGTCATCGGTGCACAGCACGCGGGGGTCGATGACGATCGCATCG
ACCCGATCAATCGGCGCAAACTCTCCGGCCGTAACGGCAACACCGCGTGCTGATCAGCCAAACCTTGGCCGAGCGCCGC
GGCGAACGCCTCCGGCGTGGTCCGGCTGGCTTTGGGGGTGGCCACCAGCGTCGCGGTCGCGGCCATGTCCGCGTCGCGGG
TCCCGGCGCCCACGAGCACCGCGCTCAGCGCTTGGATCAGCGCGAAACGCGCGACGCTGCGTTGGACAGGTTGCGTCGAC
CGTGCGGGACGCGGCCAAAGGGATTGGGGTTGGTCGGCCGGTTCGTCGGCGTGCAGCGCGAGCTGTGGTTCATGCCGGCG
CCAGGCTCTGGCTCCGGCACGGCATTCCGCGGCTTTCAGCGCCTGGATCGTCAGATCCACCGACAACGCCGCCGGCGACA
GCGTGACCGTGTGTGCGGCGGCCATGGCCAGCTCAAGGACGGTGGCGGTCGCCTCCGTGCCTATTCGATCCTCGAGTAGG
CGGCGCAGCAACGGCTGGTGGTCCACGGCCGCCACCGCTGCCTCGATGACGAGCGGAAATCGGGGCCAGCGCAGCGCCCG
GCCGCCGAGCGCTAAGCCCAGCCCGGCCGCGGTGGCGGCTACCGTTACAGCTCTGACCGCCAGCAGCACGCCGTCGCCCG
GCAGGCTCCCCGGTGATTGCGCCAGCTGATCGGCGGCTTGATCTGGGTGGCGGTGTCTTTCGGCTTTTTCGGCGTCATCG
ACAATGCGGCAAAGTTCGCGCAGTGATGTGTCGGGATCGTCGATAGCGACGACGACACGGGACAACGGGTAGTTCAGGCT
GGCCGACCCGACCCCGGGGTGGGCTTGGATTGCGTTGAGCACGACGCGCCCAAGTTCGTCGTCGCCTCCGCTGCGCAAGC
CGCGCACTTCGATCCAGGCGCGACGCTCGCCACGCCAACAGTTCCGGCCGAGTGTCTCGCGGGACAGCTCGCCGGAAAGT
GCCTTGGCTCCTGCGCGCAGCGGGATGATGGCGACCTTCATACCGGTTCCGACCCCGGTCTTGGCCAGGGTTGCCGAGAC
CGCTGTCGCGGCAGTGATCGATGCGCCGGTAAGGGCTGGCGGTCGCCCGGAAGCCCGTGGCGACAGCACGCACCGGCATAG
CCCGTGCGATGGATGCAGCAATGCTCAAGAGTTGCTCAACGCCGCCAGACTAGTTGGTGCTGCGCAGCTCAGCGGTGCCC
GCTCGGCGACCGCTCGTCTTCCTGGCTGTTGTCTTGCTCGCTTTGGCTGGCGCTTCCTTTGCGGCAGCCGGCTTGTCGGG
CACCGGCGCAAGTTTCGCCTTCACCGGCGGTGCGGCCACCTCGGGGGTGCGGTTGAGCTTCCGCAATAGCAACGCTCCGC
CGCCCACGGCCAACAGGATCGGCCAATCGACGAGTCCAGCGACACCGATCGCACCGATGGCCAACGCGGCTGCCGCGGTC
GACTTGCTGCCGCTGCTAAGCCCCTTCTGAATGCCTTTGGCGGCTCCGGTCACACCGCCGACGATGCCGCTCACGGCGGC
GCCACCCACCGCACCCGGCCGCTGTGGTGCCGTTGCTGCACCACTCACCGTTCGCCCCACGGTTCGAACTGTCCCGC
CGACCACACTCATGATGACTCCCTGGCCCAAACTGCATTCGTTTACAAATGGTTTAGCTACAGTTCTACACTCGTTAACC
CGCACCCTGCATTCGCACCGCTGACGAGATTTCTGTTCAGCGCTCTCGAAATGCAAGCCTGCCACGCCGCCCTGACTGAG
ACAACGCGCAACTGCCGCGTGCGGCGCGACTGCCGACTACCGCCGTACGCCGCCTACCCGGCGTGCAGGTCGACGAGCAC
CGGAGCGTGGTCGCTGGGCGCTTTGCCTTTACGCTCCTCGCGTACGATCTGGGCGTCCATCACCCGGGCGGCCAACGCCG
GCGACGCCGAGGATGAAGTCGATGCGCAGCCCTGTTTCTTCGGGAACCGCAGCTGCGTGTAATCCCAGTAGGTGTAAACC
CCGGGTCCCGGGGTGAAAGGCCGTACTACATCCGGTGAATTGCGCGTCGACAATGGCGTTGAACGCCTTGCGCTCGGGTTC
GGAAACGTGCGTGCAGCCGGCGAAGAATTCGGTGCTCCAGACATCATCATCGGTCGGAGCGATGTTCCAGTCGCCCATCA
GTGCGATTGGTGCGGCGGGATCGTCACGTAGCCAGCCTTCGGCCGTATCACGCAGCGCGGCAAGCCAATCCAACTTGTAG
GTGTAGTGCGGATCGTCCAGGGCGCGCCCGTTGGGCACGTAGAGGCTCCACACCCGGATGCCGCCGCAGGTGGCGCCCAG
GGCACGGGCCTCCGTCGTGGCGGCCACTTCCGGCTTGCCGCTCCAGCTGGGCTGGCCGTCGAACCCAACCCGCACGTCGT
CGAGGCCGACGCGGGATGCGATCGCCACGCCGTTCCACTGATCGAAGCCGACGTGTGCGACGTCATAGCCGAGTTCGAAC
AGCGGCAAGGCCGGGAATTGGCCGTCGGGCACTTGGTCTCCTGCATGGCCAACACGTCGACATCGGCCGCGCCCAAGCCA
ATCGAGGACACGATCCAACCGGGTGCGAATCGAATTCACATTCCAGGTGGCCAGCCGCAGCAGCGGCGATCGCAAGCGCG
GCGAAGCCGGGCGTTGGGGGTGGCCGCCGTCAATTGTGCCGTCGGGCATGGCTAGAAGGTATCCCAGCCGACCGACTGGG
CAGGAAGATAGCGGCAGTGATGGTGCAGCCGGAAGCCCAGGGACTCGGCGAGGACGGATGTCGCGGTGTCGTGCACGCGC
ACGTAGCCGCGGGTCGCGCCGCGGCCCGCTCCCCAGCCCAACAGCGCTTCCCACAATTGGCGGCCAGCGGAGCCGGTCGC
GGATTGCTCGTCGGCGGCACGCATTGCCGACAGACCCACCCACCGGGTGCCGTCGGGTGCGTCGGTTACCGCTGCACGTG
CGACCGCCACACCCAGGTAGCTGCCGAATGCCAACTCGCCGTCGATGACGGGGGTCGCCATGTCGAGGGGTAGGCGTTGG
TGGTAGAGCCGCAGCCAGGTGTCGTCGGGGTGGTCCAGCAACGTGACCGACCGGTCGGGTTCACCGGTGGACACGTCACG
CACCAACACTTGCTCTCGGCGCTCACCTGCCAGGTCGGCCGGTAGTGGCAGCAAGCGGTCCGGGACGGCCAGCCATGGCT
GCAGATCACGGCTCGCATACCATGCGCTGATTTCTGTGATGGTGTTCGTGTGTGCCGAGATATCCAGCGGTACTGCTGAA
TTAGCGGCCAGTACGGCCCCGTGTCCGGCTCGCAGGAGCCAGCCGTCCAGCCAGGTTCGTTCAACGCCGGGCCAGGCCGC
CGCGGCGGCGTGTTCAAGTGCGCGGATCGCGGCGGTGCGCACCGGCGCATCGGTCAGGACCCGCAGGGCCACCACATCGA
CGGGCGAGAACTCGACGATGGTCCCGGTCTTGGTCTGCACTCGCACCGTCGGATCGACGGCTAGCAGCCGACCCACCGCA
TCGGTCAGCGGTGGCATCGATCCGGCGGGCCGGCGGTAGCGCACCGTTACCCGTGTCCCAAGCCCGGCCACGAGACCAT
TAGTGACCGAACGGGTCGGGGTCCTCGCCGGGCAGCCACGACAGTCCGGGAACGCCCCAGCCATGTGACTTGACGGCCCG
```

FIGURE 7

```
TTTGGCGTTGCGGGCGTACCGGCCGATGAGGCGGTCCAGGTACAGGAATCCATCAAGGTGCCCGGTTTCGTGCTGCAGCA
TCCGCGCGAACAGGCCGGTGCCCTCGATACTGACCGGACTGCCATCGGCGTCGAGTCCGGTGACTCGTGCCCACTTCGCG
CGTCCGGTAGGAAATGACTCGCCGGGAACCGACAGACAGCCTTCGTCGTCGGTGTCCGGGTCGGGCATGGTCTCAGGTAT
TTCGGAGGTCTCAAGCACCGGATTGATGACCACACCGCGTCGGCGGGCGGTCATTGCGCGGTCCGCGGCGCAATCGTAGA
CGAAGAGCCGCAGGCTGCAGCCGATCTGGTTGGCAGCCAGGCCGACTCCGTTGGCGGCGTCCATGGTGTCGTACATGGTG
GCGATCAACTGGGCGAGATCCGCCGGGAGTGAACCGTCGGCGGCGACCGTCACCGGTGTGGTCGCAGTGTGTAAGACGGG
ATCGCCCACGATGCGGATGGGTACGACTGCCATGGTGGGCTAGCTTAAGCGCGCCGACGATACGCGCCGCGAGGCGGCGG
GCTGAGGAGGCGGGCAATCGGCTTAGGCGCGCCGCGGGGCGGCGGGCATCATCGCCGGGTGTGAACCACACGACGGCTGG
CCGGCATGTCGCGTCGCAGGATTCACACTCGGAGCATGAGCCGGCGCGCCGCGATCGGCAGTCGGGTGCAAGCAAGTCGG
CCGACTCGCGGGCAGGATTACCGCCCGACGGTTCCTGGCGTGGTTCAATATTCGCCGAAGAAGCGCCTACGTAGGCCAAG
TCATTCGTACACATTGAGAATTCGCCGGAAGGGCCCAGGGGAAAGCGATATGGACAGCGCCATGGCGCGGGCAATTCGAT
CGGGGGACGACGCCGAGGTCGCCGATGGGCTGACCCGGCGCGAGCACGACATCCTGGCGTTCGAACGTCAGTGGTGGAAG
TTTGCCGGTGTCAAGGAAGAAGCCATCAAAGAGTTGTTCTCCATGTCGGCGACGCGCTACTACCAAGTGCTCAATGCGCT
GGTGGATCGGCCCGAGGCGCTGGCCGCCGACCCGATGCTGGTAAAGCGGTTGCGGCGGCTGCGCGCCAGTCGGCAGAAGG
CGCGGGCCGCGCGACGCCTTGGCTTCGAGGTGACCTGACACTCTCCCCGCTTTTGCCGGTTGTGTCCCGGTGCTGGTTAC
AGTGGGCTCGATGAATGAGCGTGTACCCGACTCTTCCGGGCTTCCCTGCGGGCCATGGTGATGGTGCTGTTGTTTCTCG
GCGTCGTCTTCCTGCTGCTCGTCTGGCAGGCACTGGGTTCGTCTCCGAACTCCGAGGACGACTCGTCAGCGATTTCCACC
ATGACCACCACCACTGCGGCGCCGACGTCGACCAGCGCGTTAAGCCCGCGGCGCCCCGGGCCGAGGTGCGCGTCTACAACAT
CTCAGGCACAGAAGGCGCCGCCGCGCGGACGGCCGATCGGCTCAAGGCGGCCGGTTTCACGGTCACCGACGTTGGGAATC
TATCGTTACCCGACGTCGCGGCGACCACGGTGTACTACACCGAAGTCGAAGGCGAACGGGCCACCGCCGACGCGGTAGGC
CGGACGCTAGGAGCAGCGGTGGAGCTGCGACTGCCAGAGCTGTCCGACCAGCCGCCCGGGGTCATCGTCGTGGTGACCGG
CTGACGCTGATTCGAACGCCAGGTTAGGCTCTCGCTATGCCAAAGCCCGCCGATCACCGCAATCACGCAGCTGTCAGCAC
GTCGGTCCTGTCCGCGTTGTTTCTGGGCGCCGGTGCCGCGCTGCTGAGCGCATGCTCGTCGCCGCAGCACGCGTCTACAG
TTCCGGGTACCACGCCGTCGATTTGGACCGGATCGCCCGCGCCGTCGGGACTTTCGGGTCACGACGAGGAGTCGCCCGGT
GCGCAGAGCCTGACCAGTACCCTGACGGCGCCCGACGGCACGAAGGTAGCGACCGCGAAGTTCGAGTTCGCCAACGGCTA
TGCCACCGTCACGATCGCGACGACCGGCGTCGGTAAGCTCACGCCCGGCTTCCACGGCCTACACATCCACCAGGTGGGTA
AGTGTGAGCCCAACTCGGTTGCCCCCACCGGCGGTGCGCCCGGCAACTTTCTGTCCGCCGGCGGCCACTACCACGTGCCA
GGGCATACCGGCACCCCCGCCAGCGGCGACCTGGCCTCGCTGCAGGTACGCGGTGACGGTTCGGCGATGCTGGTGACCAC
CACCGACGCCTTCACCATGGACGACCTGCTGAGCGGCGCGAAAACCGCGATCATCATTCACGCCGGCGCCGACAACTTTG
CCAACATTCCGCCAGAACGCTACGTCCAGGTCAATGGGACTCCGGGTCCCGACGAGACGACGTTGACCACCGGCGACGCC
GGCAAGCGGGTGGCGTGCGGTGTCATTGGTTCCGGCTAGCTTGCCTGCCCGCAGGTCGGCCGCCGAATTGATTTCGCAG
GCTCACCGCGGCCCACCCTCGGTGTGGAGTGGGAGTTCGCGCTCGTTGACTCGCAGACCCGCGATCTGAGCAATGAAGCC
ACCGCGGTTATCGCCGAAATCGGCGAAAACCCGCGGGTCCACAAGGAATTGCTGCGCAACACCGTAGAGATTGTCAGCGG
TATCTGCGAATGTACCGCCGAGGCAATGCAGGATCTGCGCGATACCCTGGGCCCCGCCCGTCAGATCGTGCGCGACCGCG
GGATGGAGCTGTTCTGCGCGGGTACCCACCCCTTCGCGCGGTGGTCGGCCCAGAAGCTCACCGACGCGCCGCGGTACGCG
GAGCTGATCAAACGCACCCAGTGGTGGGGCCGGCAGATGCTGATCTGGGGTGTACACGTGCATGTCGGGATTCGCTCGGC
GCACAAAGTGATGCCGATCATGACGTCGCTGCTCAACTACTACCCGCATCTGTTGGCGCTCTCGCCCCTCCATCACCCTGGT
GGGGTGGCGAAGACACCGGGTATGCCAGCAACCGGGCGATGATGTTCCAGCAGTTGCCCACCGCCGGGCTGCCGTTTCAC
TTTCAGAGGTGGGCGGAGTTCGAAGGTTTCGTGTACGACCAGAAGAAGACCGGCATCATCGACCATATGGACGAAATCCG
TTGGGATATAAGACCCTCACCCCATCTGGGCACCCTGGAGGTGCGGATCTGCGATGGCGTGTCCAACCTACGAGAGCTCG
GCGCGCTGGTCGCGCTGACGCATTGCCTGATCGTCGATCTGGACCGCCGCTTGGACGCCGGCGAAACGCTACCGACCATG
CCTCCCTGGCACGTCCAGGAGAACAAGTGGCGTGCCGCCCGCTACGGCCTGGACGCGGTGATCATCTTGGACGCCGACAG
CAACGAACGGCTGGTTACCGATGACCTCGCGGATGTGCTGACCCGGCCTGGAGCCGGTCGCCAAGTCGCTGAACTGTGCCG
ACGAGCTTGCCGCGGTCTCCGATATCTACCGCGATGGCGCCTCCTACCAGCGGCAGCTGCGAGTGGCGCAGCAGCATGAC
GGCGATTTGCGCGCGGTAGTTGACGCGCTGGTTGCCGAGCTGGTGATTTAGCCGATGCGGGCTGGCTGAGTGTGACGTCC
GCCAGCCGCGAGGAGATTGAGGTTTAGGTGATGGCCGATTTCGCGCCGGTTGAGTTGGCGATGTTCCCGCTCGAGTCGGC
GCCGCTGCCCGACGAAGATCTGCCGTTGCACATCTTTGAGCCCCGCTACGCGGCGCTGGTCCGTGACTGCATGGACACCG
CGGATCCTCGCTTCGGTGTTGTACTGATCTCGCGTGGCCGCGAGGTCGGCGGCGGCGATACGCGATGTGATGTCGGGACG
CTGGCCAGGATCACCGAATGCGCGGACGCGGGTTCGGGTCGCTATATGCTGCGCTGCCGGGTGGGCGAACGGATCCGGGT
GTGCGACTGGCTGCCCGACGATCCGTACCCGCGTGCGAAGGTACGGTTCTGGCCCGACCAGCCGGGGCACCCAGTGACGG
CTGCCCAGCTGCTGGAAGTCGAAGACCGGGTTGTGGCGCTATTCGAGCGGATCGTCTGCCGCCCGGGGAGTTCGGCTGCCG
GCCCGTGAGGTGGTATTGGGCTACCCGGTGGTTGACCCAGCCGATACCGGGCAGCGTCTGTACGCGCTGGCATGTCGAGT
GCCGATGGGCCCGGCCGATCGGTACGCCGTGCTGGCGACGCCGTCGGCGGCCGATCGATTGGTCCGCTTGGGTGACGCGC
TGGACTCGGTGGCCGCGATGGTGGAGTTCGAGTTGTCGACGTAACTGCCCTACGCGGTGCGTCTGACCCACTGGGCCTGA
ACCACATTCACTGCGCCGAGCACCATATACGGACCCGTCACCGCCGGCAAGCGCATCCGGGTGCGGAACCGGCTCGACAA
TGGTCAACGCCTTCGCACCATTGCCGACCAGTACCCGCAATTGCTCGACTTCATCAGTGGTCGCTAGGACCGAAGGTCAC
```

FIGURE 7(continued)

```
CCTTGGTGCCGAACTTACGCAGCGACGCCACCTGCAGCGGATCCAGCGACGCGCGCACGGTTTCTCGCGCGGTCGCCAGG
TCGGCGGCGGTGACGTTGGCGGCATCGATGGAACGCCGCATCGCGGTAAGCGCGGCTTCGCGCAGCAGCGCCACACAGTC
GGCGGCACTATAACCGTCGAGTCCGGCTGCCACCTCGTCCAGGTCGACGTCGGAGCTCAGCGGGATCGACTTGCCAGCGG
TGCGCAGGATTTCGCGGCGAGCGGCAGCGTCGGGCGGTTCAACGAACACCAGCCGTTCTAGCCGCCCCGGGCGCAGCAGC
GCCGGGTCTATCAGATCGGGCCGGTTGGTCGCGCCTAGCATGACGACATCCCGCAGCGGGTCAATACCGTCGAGCTCAGT
CAGCAGCGCGGCCACCACCCGGTCGGAGACGCCCGAGTCGAAGCTCTGACCGCGCCGTGGCGCCAGAGCGTCCAGCTCGT
CGAGGAACACCAGTGACGGCGCGGAGTCGCGGGCCCGCCGGAATAGCTCGCGGACTGCCTTCTCCGAGGAGCCCACCCAC
TTGTCCATCAGCTCCGACCCTTTGACGGCATGCACGCTCAACTGTCCGGTGCTGGCCAGGGCACGAACCACAAAGGTCTT
GCCGCAGCCGGGCGGGCCGTACAGCAACACCCCGCGCGGCGGTTCGACACCTAGCCGAGCGAAGGTGTCGGGGTGCTGCA
GCGGCCACAGCACCGCCTCGGTCAGTGCTTGTTTGGCCGCGGCCATGTCACCGACATCGTCGAGCGTCACGTCACCCACG
GTGACTTCGTCGCTGGCCGAGCGGGACAGCGGCCGGATGACGGTCAACGCACCGAGGAGGTCGTCTTGGTGCAGCATCGG
TGGTCGGCCGTCGGCACTGGCTCGAGACGCTGCCCGCAGCGCCGCCTCGCGAACCAGCGCAGCCAGGTCGGCCACGACGA
AACCCGGTGTGCGGGAGGCGATTTCGTCGAGGTTGAGGTCTCCGGTAGGAACCGGATTCAGCAGCGCCTCCAGCAGCGAT
TTGCGGGTGGCCGCGTCGGGCAGCGGCAGGCCAAGCTCCCGGTCGCACAACTCGGGGGAACGCAGCCGGGCATCGAGTTG
ATCGGGCCGTGCTGAGGTGGCGATCAATACCACACCGGCGGTGGCCACCGCGGTACGCAGCTCGGACAGGATCAGCGAGG
CTACCGGCTCGGCGGCGGCTGGCAGCAGGGCGTCGGCATCGGTGATCAGCAACACACCGCCCTCATGGCGAACCGCCTGC
ACTGCCGAGGCCACGGCTTTGACCCGGTCTCCGGCGGCCAGAGCTCCAATCTCCGGACCATCCAGTGTCACCAACCTTCG
GCCGTCGCACACCGCGCGCACCAGCGTCGCCTTGCCCACCCCGGCCGGACCCGACACCAGCACACCCAAATTGGTGCCGG
CGCCCAAGGTCTGTAGTAGGTGCGGCTCATCGAGGGCAAGCTTGAGCCATTCGGTGAGCTTGGCAGCCTGCGGCTGGGCG
CCCTTGAGCTCTTCGATCTGGATCTCCGGACTCGAGATGCTCACTTGCCCGGCCGTGGACGTACCCATTGCGGCCGGGAC
CCCAGCGCCCCAGGTGACCAGCGAGTTGGGCTGCACGCTGACCGGCCCGTCGGGGTCGACGCCGGTAACGGTCAGCAGCT
CCGAGGTCCAACTGATCCCGACCGCAGCTGCCAATGCGCGGCTGGCAGCCGACGTGGATGTGCCGGGGCCTAGATCGCGG
GGCAGCAGCGAGACCGCGTCACCGACGGTCATCACCTTGCCGAGTAGGGCCTGCCGCAGCGTGACCGGCGGCACCGACTG
GGTGGCCAGCGTTGAACCGCTCAGCGTCACCGATCGCGCTCCGTAGACGGTGACCGGGCTGACGATCACCTCGGTGCCTT
CGCGAAGGCCCGCATTGGACAGTGTGACGTCATCGAGCAGCACCGTCCCGACCGCGGTGTCTGCCGCGGCCAGGCCGGCG
ACCGCGGCGGTTGTCCGAGAGCCGGTCAGCGACACCGCGTCCCACTCGCGGATGCCAAGGGCAGCAATGGCATTGGGGTG
CAACCGAACGACGCCGCGGCGTGAGTCGACGGCCGAGGTGTTCAGCCGGGCGGTAAGGGTGAGTTGGCGGGCCGGGTCCG
GGTGGGTCACAGCCGTCGACCCGGCTTGCGCAGGCCCAGCCGCCATCGACGGCCGGTAGGGATGCGCCCGGCGGCTCG
CGCGCCGCACCGCGCGCCGTTGCTTGGGCTTGTCGTCCCACACCTCAGGGTGTTGGGCAAGCCAGCCGCTGGCTGCGCACC
GCGAAAGGAATATGGCACATGTAGGCGATGATGATCACCCAGATCAACAAGTAGGGGGCCAGGACTGCGGCCGCCGCGCA
GATAGCCAGCACCGCCAGCAGGGCGGCCGCGTAGTTGGGTGGTACCGACACGGCGTGCATCTTTTTCATCGGGATCCCGC
TGACCAAGAGTATCGACGTTCCCGTCACCCAAAAGCTGAGGAACCAGCCCGAGGTCCACCATCCTTCGCCGAACTGCATT
TTGAGGGCTAGCAGGCCGATCATGGAAACCGCGCCCGCCGGCGCGGGCATTCCGACGAAGAATTCATGCGCGTAGGCGGG
CTGGGTTCCGTCGTCCTGCAGTGCGTTGTACCGCGCCAGCCGTAATACCACGCACACCGCGTAGAGCAGCACGACCACCC
AACCGACCGGCCACTTCGACAACATCGACACGTAAAGCACCAGCGCGGGTGTCACTCCGAAGTTCACCGCGTCGGCCAGT
GAGTCGATCTCTGCGCCCATCCGCGACTGGGCATCCAGGATGCGGGCCACCCGGCCGTCGAGCCCGTCGAGGATGGCCGC
TGCGGCGATCAGTGCCATCGCGGCCTTCGGCTGGTGCTCGAGCGCAAACTTGATTGCGGTCAGTCCCGCGCAAATGGACA
GCACCGTCATCGCGCTGGGCAGTATCTGCAGGTTTACCCCTCGCCTGCCGCGGGCTTTCCGATCATCGACATTCGGCCA
GCACGGTCTCGCCGGCGACCGCGCGCTGGCCGACGTTGACGATCGGCTCTGCGCCCGCTGGCAGGTAGGTATCCAGCCGG
GAGCCGAACCGGATCAGGCCGTAGGTGTCACCGATGGCCAGCTTGTCTCCGACGTGTGCGTCGCACACAATGCGGCGCGC
CACCAGCCGGCGATCTGCACCGCGACCACCTCGGCGCCGTTGGGCATGCGGATCCGCACACTGGTGCGCTCGTTGTCGT
CGCTCGCCTCCGGTAGGTCGGCCGACCCGAACCGGCCCGGCGGTGTTGCACGCGGATCACTTCCCCGCTCACCGGGGCA
CGTTGCACGTGGGCGTCCAATATCGACAGGAAGATGCTGACTCGCGGTAACGGCGTGTCACCCATGCTGAGTTCGGCCGG
TGGGGCCGCTGAGTCGATCGCGCAGATCACGCCGTCGGCGGGCGCGACAATGGCAGCCGGCCTGGTGGGCGGTACCCGCT
GCGGGTGCCGGAAGAAGCCCGCGCAGGCAGCGGCCGCCAGCAGACCCGTGCCGCGCAACCACCGGTAGCGGTGTCCGACG
GCCGCAATCGCAAGGCCGGCGGCAATGAACGGCCGCCCGGCCGGATGAACCGGTGGAACGGCGGACCGCACCAGGGCGAG
CAGATGTTGCGGGCCGTCGGGGCGGGGGCGTCTGGCCACGGGTCATCTTACGGAGCTTCGTGCCGCAGGTTGGGTGCAC
GGCACTAGGATCGGTCCGGTTAGGTCAAGTCCCAGACTTGCAGCTGCGTTCCGGCAGCCACCTCCACGACGTCCTCCGGG
ATGTCCAGAAGTCCGTTGGCCGATGCCAACCAACGCAAATGGTGCGACGCCGGTGGGCCGTAGCTGATGACCGTGCCTGC
CTGGTGATCGAGTATTGCGCGTCGGAACTGACGTTTGCCGCGCGGCGATGTCAGGCTCGCGGTGAGTACCGCGCTTCGGT
GCGGCCGGTACGGATCCGGCAGGCCCATGGCCATGCGCAGCGGGGACGGATGAACACCTCGAAGGACACCAGCGCGCTG
ACCGGGTTGCCGGGAAGGGTGACGATCGGCGTACCTGCCACCCGCCCGACGCCCTGGGGCATTCCGGGTTGCATCGCCAC
CTTGACGAATTCGACACCGTGGTCGCCTCCCCGGTAGTCAGCGCTGCCGAACGCGTCTTTGACCACCTCGTAGGCTCCGG
CACTGACACCGCCGCTGGTGATGATCAGGTCGGCGTCCACCGCGTACCGGTCAAGGATCGCGCCGAACTGCGCGACGTCG
TCGCCGGCGGTTGCGGTGGCGACCACAGCGGCGCCCGCATCGCGGACGGCAGCGGCCAGCATGATCGAGTTGGACTCGTA
GATCTGACCCGGTTGTAGGGGCGTGCCTGGCGACGCCAGCTCCGACCCTGTGGAGATCACCAGCACCCGCTGACGGGGGA
```

FIGURE 7(continued)

```
GCACCGGCAGCTCGGCCAAACCCAGCGCGGCGGCCAGGCCGAGCACCGCCGGGGTCACGATCTGGCCGTTGTGCAGCACC
GTGGTACCGGCGGCGACGTCTTCGCCCGACCGTCGGATGTGCTTGCCTGGGGTGGCCTGTTGGCGGATCGCCACCGAATC
GACGCCGCCGTCGGTGGCTTCGACCGGCACGATCGCCGTCGCACCGGTGGGCACTGGCGCACCGGTCATGATCCGGTGCG
CAGTCACAGGCTGCAGCGTCAGCATGTCGGCGCGCCCGGCGGGAATGTCCTCGGCGACCGGCAACATCACCGGATTTTGC
GGTGTGGCACCTGAGGTGTCTTCGGCGCGCACCGCATAGCCATCCATTGCGGAGTTGTCGAAAACCGGCAGCGACAGCGG
TGCGACCACGTCGCCGCCCAGGACCAGACCTTGAGCCTGGGTCAGCGGAACCGTAATCGGGCGACAGGCGCGCATCATCT
CCGCTACGACACGTTGATGCTCCTGGACTGACCGCACCCGGCCATTATCGGTCGTTCAGACTCCGAAGCTGACGCCGGTG
AGTTCTTCGGAGACGGTCCAGAGGCGGCGCTGCAGATCTTTGTCGTGGGACTGCGCGCTGGATTGGACCACCTTCGGGTG
ACCGCGCTGCTCGCCGAACCCGTCCGGGCCGTAGTATTGCCCGCCCTGCGTGGTCGGATCGGTGGCGGCACGCAGTGTTG
GCAGGGCGCCCATCTCTGGGCTTTGGAAAAGCAACGGCCCGAGCACGGTAGCGACGGGCCGGATAAGTCGCGGCAGGTTG
CGAGTCAGCTCGGTGTTGGAGCCGCCAGGGTGAGCGGCGACGGCGATGGTGGATTTGCCCGCTTCGCCCAGCCGGCGTTG
CAGCTCGTAGGTGAACAGCAGATTAGCCAGTTTGGCTTGTCCGTAGGCGGCGACGCGGTTGTAACGGCGTTCCCACTGCA
AGTCGTCGAAGTGGATGGCAGCGTGAATCCGGTGGCCCTGGCTGCTGACGGTCACCACCCGCGAACCGGGTACCGGCAGC
ATGTGGTCGAGTACCAGTCCGGTTAGTGCGAAATGACCGAGATGGTTGGTACCGAACTGCAGCTCGAAACCGTCCTTGGT
GACCTGCTTCGGCGTCCACATCACGCCGGCGTTATTGATTAGCACGTCGATGCGCGGATAGGCCGTGCGTAACGCGTCGG
CGGCTGCGCGCACCGAGTCCAGCGAGCACAGATCGAGTTGCTGCAGCGTGACGTGGGCGCCTGGGCGGGCGGCCATGATG
CGGGCCCGGGCGGCGTTGCCCTTCTCGAGATTGCGGACGGCCAACACTACGTGTGCACCGCGGTCGGCAAACACGGCGGC
GGTGTGGTAGCCGATGCCGGTGTTGGCGCCGGTGACCACAACGACGCGCCCGCTTTGATCGGGGACGTCTGCGGCCGACC
ATTTACGGGTCTTGTTGTCGTTGGCGGTCATGGGCCGAACATACTCACCCGGATCGGAGGGCCGAGGACACGGTCGAACG
AGGGGCATGACCCGGTGCGGGGCTTCTTGCACTCGGCATAGGCGAGTGCTAAGAATAACGTTGGCACTCGCGACCGGTGA
GTGCTAGGTCGGGACGGTGAGGCCAGGCCCGTCGTCGCAGCGAGTGGCAGCGAGGACAACTTGAGCCGTCCGTCGCGGGC
ACTGCGCCCGGCCAGCGTAAGTAGCGGGGTTGCCGTCACCCGGTGACCCCCGTTTCATCCCCGATCCGGAGGAATCACTT
CGCAATGGCCAAGACAATTGCGTACGACGAAGAGGCCCGTCGCGGCCTCGAGCGGGGCTTGAACGCCCTCGCCGATGCGG
TAAAGGTGACATTGGGCCCCAAGGGCCGCAACGTCGTCCTGGAAAAGAAGTGGGGTGCCCCCACGATCACCAACGATGGT
GTGTCCATCGCCAAGGAGATCGAGCTGGAGGATCCGTACGAGAAGATCGGCGCCGAGCTGGTCAAAGAGGTAGCCAAGAA
GACCGATGACGTCGCCGGTGACGGCACCACGACGGCCACCGTGCTGGCCCAGGCGTTGGTTCGCGAGGGCCTGCGCAACG
TCGCGGCCGGCGCCAACCCGCTCGGTCTCAAACGCGGCATCGAAAAGGCCGTGGAGAAGGTCACCGAGACCCTGCTCAAG
GGCGCCAAGGAGGTCGAGACCAAGGAGCAGATTGCGGCCACCGCAGCGATTTCGGCGGGTGACCAGTCCATCGGTGACCT
GATCGCCGAGGCGATGGACAAGGTGGGCAACGAGGGCGTCATCACCGTCGAGGAGTCCAACACCTTTGGGCTGCAGCTCG
AGCTCACCGAGGGTATGCGGTTCGACAAGGGCTACATCTCGGGGTACTTCGTGACCGACCCGGAGCGTCAGGAGGCGGTC
CTGGAGGACCCCTACATCCTGCTGGTCAGCTCCAAGGTGTCCACTGTCAAGGATCTGCTGCCGCTGCTCGAGAAGGTCAT
CGGAGCCGGTAAGCCGCTGCTGATCATCGCCGAGGACGTCGAGGGCGAGGCGCTGTCCACCCTGGTCGTCAACAAGATCC
GCGGCACCTTCAAGTCGGTGGCGGTCAAGGCTCCCGGCTTCGGCGACCGCCGCAAGGCGATGCTGCAGGATATGGCCATT
CTCACCGGTGGTCAGGTGATCAGCGAAGAGGTTCGGCCTGACGCTGGAGAACGCCGACCTGTCGCTGCTAGGCAAGGCCCG
CAAGGTCGTGGTCACCAAGGACGAGACCACCATCGTCGAGGGCGCCGGTGACACCGACGCCATCGCCGGACGAGTGGCCC
AGATCCGCCAGGAGATCGAGAACAGCGACTCCGACTACGACGTGAGAAGCTGCAGGAGCGGCTGGCCAAGCTGGCCGGT
GGTGTCGCGGTGATCAAGGCCGGTGCCGCCACCGAGGTCGAACTCAAGGAGCGCAAGCACCGCATCGAGGATGCGGTTCG
CAATGCCAAGGCCGCCGTCGAGGAGGGCATCGTCGCCGGTGGGGGTGTGACGCTGTTGCAAGCGGCCCCGACCCTGGACG
AGCTGAAGCTCGAAGGCGACGAGGCGACCGGCGCCAACATCGTGAAGGTGGCGCTGGAGGCCCCGCTGAAGCAGATCGCC
TTCAACTCCGGGCTGGAGCCCGGGCGTGGTGGCCGAGAAGGTGCGCAACCTGCCGGCTGGCCACGGACTGAACGCTCAGAC
CGGTGTCTACGAGGATCTGCTCGCTGCCGGCGTTGCTGACCCGGTCAAGGTGACCCGTTCGGCGCTGCAGAATGCGGCGT
CCATCGCGGGGCTGTTCCTGACCACCGAGGCCGTCGTTGCCGACAAGCCGGAAAAGGAGAAGGCTTCCGTTCCGGTGGC
GGCGACATGGGTGGCATGGATTTCTGACCCCGGCGAGAAGTCGCAGCGAGGAGCCCGGTCCCTTTGTGGGGCCGGGCTCC
TCTGGTTGGGAGCTACGGTACCGAGAACACCACGCAGTCGTGTAGGCAACCTTTGGCCGCTGTGGGCGAGTCGGGGCCG
CGTCTCGGTGCAGCAGCGCGCGGATGGGTACGACACCGCAGCGGGCGGTGTCGTCATCGGGGCCTGCGTCCGACGCCTGG
GCACGGCCGTCGACGATCAGCGAGTAGCCGCTAGGATCGGATGGCGGCCACAACAGGGTGACTTCGCTGCGGTGGGCCAG
GTTTTGCCGCGTACGACCCCCGATCAGGCCGACGTCGACCACTGCCCGGGGTCCATCGGGGCCGTCGGGGAGTTCGCGCA
GCACCGGCTCGACTGCCACCGTGTGCACGCGATGGCCATCATCGACGGTGATCAGGTAAGCGAACGGGTAGTCGGGCAAG
GCGGCGGCCAGCCGTTTGAGGTCTACCTTTTTGGCACCCACGGATTCGAGGATAGGCGCCCGATGTGTTACTCCGAACCG
ACCGGCTGCCCGATCCGCGGGCTGGCGTAGGCGGATTCGCGGTCGGGGCTCGGGTAGAAGTTCGACTTGGGGATGCCGGA
GCCGGGGGTACTCGGCTCACGCACGGCGGTATTCCGCAAGCCCGAGTCGTTGCTGCCCGAGTTGACGAAGCTCGGGTAGC
TGGTGCCAGGGCTTCTAAGGCCCGGGTTTGCGCCCGAGCCAGCCGCGGCACTGCCGCTACCGGGGTTCGGGTTGCCTGAG
TCCAGGCCGCCAACAGGAGCACTGGCCGGGGCGGCGACGGGCGTGTTGGTCAGGCCCGAGTTGAGGACGTTCGCCAGGCC
GTGTTGGAGACCGCCCGTTGATCCGAGGGCGGAGGCGAGGATGCCCGAACTCAAAGCCGCCGTGCTCATGCCGCCGGTGG
CGTAGCCGGCGGAGCTGACCAAGGCCGCCTCCGAGCCAGCCGCGCTTCCTAAGCGGCGTTTTGCATCCCCGCGTTCCAG
AAGCTGGTGTTGAGGCTGCCTGCGCTGCCGAGGCCCGCGTTGATTGTCCCCGAGGTCCCGATGCCGCTGTTCAGGGAGCC
```

FIGURE 7(continued)

```
CGAATTCCCGATGCCGATGTTTCCGCTGCCGGAGTTGAATAAGCCGACGTTGCCGGTGCCCGAGTTCCCGAAGCCGATGT
TGCCGCTACCCGAGTTGAAGCCGCCGAAACCCATCTGGTGATCACCGGTGATCCCGAACCCGATATTCCCGCTACCGGTG
TTGCCGAAGCCGATATTCCCGTCGCCGAGGTTGCCGAGGCCCAGGTTGCCGCTGCCGGTGTTGCCGCTGCCGATGTTGCC
GGTGCCGGTGTTGCCGCTGCCGATGTTGTTGTTGCCGATGTTGTTGTTGCCGATGTTGCCGCTGCCGGTGTTGCCGAAGC
CCAGATTGATCTGGCCGTTCTTGCCGATGTCGATGCCGAGGTTCCGCAAGACCTGCTGCCAGGGCGCCAGTTGTGCGACG
GCCGCAGACGCATCGAAGTGGTAACCAGCCATCGCCGCCACGTCCAATGCCCACATTTGCTCGTATGCCGCCTCGACGTC
CATGAGCGCCGGAGCATTCTGCCCAAACCAGTTCGTAGCTGCCAGCAGCTGCATCAGGCCACGATTGGCCGCTACCACTG
CCGGCTGCACGGTGGCCGCCAGCGCCGCCTCGAACGCGGTCGCTATTGCCATGGCCTGTGCGGCCGCTTGTTCCGCCTGC
GCTGCCGCCGTGCTGAGCCAGGCTAGGTACTGGGTTGCGACGGCCATCATCGCCGCCGCGGACGGACCCAGCCAGGCGCC
ACTAGTCAGTTCGGATGTGACGGAGCCAAGCGACGCTATTGACGCGAGCAATTTTTCGGCCAGCTCGCCCCAGGCGGTGG
CCGCAGCAATTAGCGGTCCCGACCCGGGACCGGCAAACATCAGTGCCGAATTGATCTCTGGCGGCAACCACGCAAAATGC
GGGCTTGTCACTGATCCAACTTAACTGTCAGCGACCGTTGCCGTGGCGGTATCGGCACTTCAATACCACTCATCTTTGGG
GTCATCTTTGGAGCGCCCCTAGGAACCGCCAGCTTACCTAGTCCCGGGTAGGGGCCGACTGGCGGCCGGGATGCAGCTGA
GGGTCTGCCACCTGCCCCGTAATGTCGCTGGTATGGCAAGCACCGACGCCGCGGCCCAAGAGTTGCTCCGCGACGCGTTC
ACCCGGTTGATCGAACATGTCGACGAACTCACCGACGGCCTCACCGACCAACTCGCCTGCTACCGCCCGACCCCCAGCGC
CAACAGCATTGCGTGGCTGCTCTGGCACAGCGCCCGGTGCAGGATATACAGGTCGCCCATGTGGCCGGCGTGGAAGAGG
TGTGGACCCGCGACGGTTGGGTGGACCGCTTTGGGTTAGATCTGCCGCGGCACGACACCGGATATGGACACCGTCCCGAG
GATGTGGCGAAGGTACGGGCACCCGCCGACCTGCTGTCGGGTACTACCACGCGGTGCATAAACTGACCCTGGAATACAT
CGCTGGCATGACCGCAGATGAGTTGTCCCGTGTGGTGGATACCAGTTGGAATCCGCCGGTTACCGTCAGCGCACGGTTGG
TGAGCATCGTCGACGACTGCGCTCAGCACCTCGGGCAGGCCGCCTACCTGCGGGGATAGCCCGATAACGGCGACATCCG
CCGGATCGCTGAGGCGATGGTCAGCTACGCCGAAGATCGCCTGCACCGATGGTTACCTGACGCTAGCCGGCAGCGCCGCC
CTAGTGGTACCCGCCGTGTTCGTCGCGATGCTGGGCACCATTGTCGCGCCGAGACTGCGGTGAGGGGCCGGGGTGTGCGT
CCTCGGCTCACCCGAGCGGCAGCTCGGCCAAGATGGTACCGGTGGGCTGTGGTGATCCGGTGCCGGGTTCGACGGTGAAT
GCCAGTGCGGTCGAGGCTCCGAGATCGGTCAGCGTCGCCGTCGTCGAGGGCGTCACCGCCGCGGTGCCCATCGTCCCCGC
CGACCTCGGCCCTTTGGCCCCTCCCAGCAGCCACATCTGATACACGGTTCCCCGGGATGGTGGCGCCACATTGTTCATCA
CCAGCAGACCTGTGTTGCGGTCGCGGGAGAACACCACCGTGGCCGTCCCGGCGCCCAGTGGGCGAGAGACCGTCCGTACG
TCCGGCGCCGTCAGAACTTGCTCGGCCACGGTGGGGGGTGGCGATGGCCGGGTCAGCACCCCCAGGCCGAACGCCCCAG
CCCCACAGCGATCGCCGCTGCCGACCGCAAAGGCTGCCGTACGCCAGCGTGATTGGCGCCTAACCTCGGGCTTGGTCGCAT
CCAGGATGGCCGTCCGCAGATGTGCTGGCGGCTCGGCGGTGGTGGCCGCCGAGACGACGGCCATCGTCTCGCGGACGGCT
CGAACTTCGTCGTTGAAAGCCGCGGCTACCGGCGAGGGCGCGGCGGCCACCCGTCGGTCGATGTCGGCTCGTTCATCGTC
GGACACAGCGTTCAGGGCATACGGGGTAGCCAGCTCGAGCAGCTCAAAATCGGTATGTTCAGTCATGAGCGCCGCTCTCC
CAACGCATCGCTTCGCTCGGCCGGCGCAGTCATGACACGTCCAGGCAGTTGCGCAGGCTGCGCAGGGCGTCGCGCATGCG
GGATTTGATGGTCGACAGATTGGCCGCTAACCGCCGCGAAACTTCGACATACGTCAGCCCGCCGTAGTAGGCCAGTTCGA
TGCACTGCCGCTGCGTGTCGGTCAACGCCTTGAGGCACTCGGTCACCCGGCGCCGCTCATCACCGGCGATCGCCAGGTCG
GCGACGACGTCACTCGCGGGATCGACGTTGGCCGCACCATAGCGCACTTCCCGCTGGTTGCCGGCTTGCTCGCAACGGAC
TCGGTCGACAGCGCGCCGGTGGGCCATGGTCAAAAGCCAGGCCAACGCGGAACCTTTGGCGGAGTCAAACTCCGACGCGT
TCCGCCACACCTCAAGATAGATCTCCTGGGTGGTTTCTTCGCTGTAGCCGGTATCACGCAGCACCCGCATCACCAGTCCA
TACACCCGCGACTTGGTGTGGTCGTAGAATTCGGCGAATGCGGCCTGGTCGTGACCAGCGACCCGGCGCAACAGGGCGTC
CAGGTCGCTGCTCAGCCGTGGCGGTCCGGTCATCGATGGGTAGCCTATCGCCAGCCGGCGCCGTGATGGTCAAGCCGGTC
ATCACCGACGCGCCGATCGCGGTGGCCGGGGCACGAAATAGGCTGTTCGCCTTTGATATTCGGCGAAACCGGGGCGACCC
TTCAGGTATCTCTCAGTCAGCCGGGCTCCGCTGACGTCCACCAGCAGGTAGGTCATCAGCAGCGGCGAACCCACCGTGGC
CAGCGGCGCCCAGTCGTTGATCGTGATCAACCACAACCCCCACCAGACACAGGCATCGCCGAAGTAGTTGGGGTGACGCG
TCCAGGCCCACAGGCCGCGGTCCATGATGACCCCGCGATTGGCCGGGTCGGATTTGAATACCCACAGTTGCCAATCTCCC
ACCGCTTCGAAGGTGATACCGACCAGCCACACGGCTAAGCCCACGCCCCCAACAGCCAGTAACGGCTTCGGCGTCGGCCC
GGTGACTGCGGAAAGCTGCAGCGGGAATGAGACGAACAACGTCAGGAGGCCCTGTAATCCGAAGACCTTGCGCAATGCCT
GCACAGGCGTGGCACCGCGCAGCAGGTCGGCGTAGCGGGGATCCTCCCCCTGACCGGCTGTCTTGCGGTACATGTGCCAG
CTCAGCCGCAGACCCCAGGTCGACACCAACGCTAGTAGCAGCCATCGGCGAACCGGGTCGCCGTGGCCGAGCGTCGCGGC
GGCGACGGCGACGGCGACGAAACCCAAGCCCCATACCACGTCGACGACGTTGTACCGGCCGATGCGGCGGCCGATCGCAA
ACGCCACCGAATGCACCACGGCCACAGCCAAAGCCGACACGCTGGTTACCACGACGATGTTCACGGGGGCCCTCGCGGA
TCAACGTCCACTGGTAGACGTCCAGATAGCCCGACCGGAAGCCCGCCTCCGAGTACGCCAGGTACAGCTCCCACATCCGT
GCAAACACCTCGTCGAAACCTAAATGCGCCAGCCCATCTCGCCGCTGCATAAATCGTTCCCGCCAGAGCCGCAGCGTCTC
GGCGTAATGCGGTCGCAGCGAGGCCGCGTCGACGATGCGCAGCCCGGTGTGTTGCCCGGTGATGTCGATGATGGCCTGCG
TGGACGGTAGCAGTCCGCCAGGGAAGATGTACTTCTGGATCCAGGTCTGGGTGTGGCCGGGTGGCCAGCATTCGGTGGTGC
GGCATGGTGATCGCTTGAATCGCTACCGGGCCACCCGGGCGCACCAACTGTTCTAGCGCGGCGAAGTACCGTGGCCACGA
ACGGTATCCCACCGCCTCGATCATCTCGACTGAGACTACTGAGTCATACTGCCCGTCGACGTCGCGGTAGTCGCACAAGT
CGATCTCTACCCGGTGGCCAAAGCCGGCCGCGGCGACCCGCTGCCGAGCCAGCCGTTGCTGCTCCACCGATAGGGTCACC
```

FIGURE 7(continued)

```
GAGCGGATGTGGGCCCCCCGTGCGGCCGCGCGAATGCACAGCTCGCCCCATCCGGTGCCGATCTCGAGAACGTGGCTGCC
CTGCTGGACCCCGGCCACGTCGAGCAGCCGGTCGATCTTGCGGCGTTGGGCTGCGGCCAACTCGGTCCAGGCGGGAGTTG
GCTGGGCCAGCAGGTCGGTGAACATTGCGCACGAATACGTCATGGTCTCGTCGAGAAACGCGGCGAACAGGTCGTTCGAC
AGGTCATAGTGCACGGCTATATTGCGCCGGGCCTGATCTCGGCTGTGGTCTGGCCAACTAGGTCGAAAGGTCGGCGTGAT
CGGCCGCAGCCAGTGCAGCGAGCGCGGTACCAGCTCGTCCACCGACCCTGCCAGCACGGTCAACACCCGCGTGAGCTCCT
TCGACGACCATTCGCCGGCCATGTAGGACTCGCCGAAGCCGATCAAGCCGTGGCGCCCGATCCGGCGTGCAAGTGCGTCC
GGCCGATGGATGAACAGGCTGGGTGCGCGCGGATCGGCGGCACCTGTTGCCGTTCCGTCGGAGTAGACCAATCGCAGCGG
CAAGTGAGTGGCCGTGCGCCGAAGCAGCCGGTTGGCGATTGCCGCCGATGCCGCGGCTAGGGGACCGCGCGGCACCTTGG
CAACCGCTGGCCAGCGATCCGAATCGATTGCTGCCGACGGTGTCTGGCTGGTTTCGACGGTCATCGCGGCACCACCGGAA
CTCGACGTAGCCACAGTCTGATCCCCTGTATCCTGATGCGCGCGGCCACCACCATCGGCGCCAGCGGTGAAATGATTTGC
ATCATCGCGATCTGTCTTGTCGTTGCCGGTCGCCGCTGCCCACGCAGGGTGGCTGTGAATTCCGGGCACACCTGCCGGCG
GTCACGGTGCAGCGTCACCGTGACGTCGAGTTCGCGGTCGGGCCGTGGTGCCCGTATCAGGTAGTAGCCGGCTAGCTGAT
GAAACGGCGAAACGTAGAAGTTCTTGGCCGTCACCACGGGCAGGTCGGCCGGCGGTAGCAGGTAAGCATGGCGTCCGCCG
TAGGTGTTGTGCACCTCGGCAATGACATGGCGCAGTTGGCCGTCGCGGTCGTGGCCACCAGAAGATGCTCAACGGGTTGAA
GACATAGCCGAGAACGCGTGCTTGCAGCAGCGCGGTGATACGGCCGTCGGGGACGGCAAGGCCGCGAGCGGCAAAGAAGG
CGTCCAGCCGGTCACGCAGCGAGCTATGCGGCGGACACGAGAACGGGTCAGCGAAGTGGTCGTCGGCGTGGAACCGTGCG
AACGGTCGCAGCCACCAGGGCAGCTGGGGGAGGTTGTCGACATCCACGTACCAGCTGTAGCTGCGGTATGCGAACGAGTG
GTGCACCGGGACTTGTCTGCAGTGGCTGATCGTGGTGCGGTAGATCGCCGGCGTCAGGGTTTGAGTCAGCACGCGACCAT
CGCCTCCTGTGGGATCGCTGCCGGCCAGTCGGCGCCAAGGCGCCGGGCCGCCCGCAGACCCGAGGCGGCGCCGTCCTCGT
GGAATCCCCAGCCGTGGTAGGCGCCGGCGAATACCACCCGATTGTCACCCAGCGTCGGCAATAAGCGTTGGGCTGCAACC
GATTCCGGTGTGTACAGCGGATGGCTGTAGGTCATCTCGGCGATCACCGAGCTGGGATCAACCCGGTCGTGGCCGCCGAG
GGTGACCAGATACCGGCGGCCACCGTCGAGGCGCATTAGCCTGCTGATGTCGTAGCTGACCACGACCTGGTGCTGCCCGG
GTGTCACCAGGTAGTTCCAGGATGCGCGGGCGCGATGGTGGCGGGGCAGGACCGACTCGTCGGTGTGCAGCTGGGCGCTG
TTGGTGGAGTATGCGATCGCGCCCAGGACCGCGCGCTCGGCCGGTGTCGGCTCGTCGAGCAACAGCAGCGCCTGGTCGGG
ATGGACCGCGACGACGGCCGCATCGAAACGCCGCGACGGCCCATCACCCGCGCCCACCAATACCCCGTCCGGCAGCCGGC
GCAGCGAGTGCACTGGCGTGCGGGTCGACACCTCGTCCAGCTGAGCTGCGATCGCCTGCACGTAGTTGGCGGAACCTCCG
GTGACGGTACGCCAGGTTGGCGACCCGAACACCGACAGCATGCCGTGATGGTCGAGGAAGACGAACAGATACCGGGCCGG
ATAGCGCAAGGCGTCGGCCCCGCCGCGAGGACCACACGGCGGCGACCAAGGGTGTGATGAAGTAATCGACGAAATACTGCG
AGAAGTGGTGCCGGCTCAGGAAGGCTTCCAGCGTCTCCGGTTTGTCTTCCGCGTTGTCGGTCTCCTCACGCAGCAGGCGA
GCCGCGGCGCGGTGGAAGCGGAGAATCTCGGCAAGCATGCACAGATACCGTGGCCGCAGCGATTGCCGGCAAGCGAACAG
CCCGCGCGCTCCCAGTGCGCCGGCATATTCGAGTCCGATGTCGTCGGCGCGCACCGACATCGACATTTCCGACTCCTGGG
TGGCCACACCCAGTTCGGCGAACAATCGGCACAACGTTGGATAGGTTCGGTCGTTGTGCACCAGGAACGCCGAGTCGACG
CCGACGACGTCGGTGCCCCGGGGGCCGCCACCGTTGTCCAGATAGTGGGTGTGGGCATGACCGCCCAGCCGGCCGTCCGC
CTCGTACAGGGTGACTCGGTCCCGTCCAGACAGGATGTAGGCGGCGGTGAGGCCGGCGACCCCACTTCCGACAACAGCCA
CCGATCGTCGGAGTGATTGCTGCACATCCTGTATTCGGAGCGGCCGGCTAGACGGACGGGCGGTTCAGCCGAGGCGGTCG
CTGCTCATCGCCAAGGGCCGGCCCGCGGGCTGGGTTTCGCTGGGTACGGTCGGGGTCCGGGCGGGCCGGGAACGCACCCG
CAGCGGCCACCAGAACCAGCGGCCCAGTAGTGCGGCGATGGATGGCGTCATGAACGATCGCACGATCAACGTGTCGAACA
GCAAACCCAGACCGATGGTGGTGCCCACCTGTCCGATAACCCGCAGATCGCTGACGGCCATGGACGCCATGGTGACGGCG
AATACCAGCCCTGCGTTGGTCACGACCTTGCCGGTGCCGCCCATCGACCGGATGATGCCGGTCTTCAGCCCCGCTCCTAT
TTCCTGTTTGAACCGGGAGACCAAGAGCAGATTGTAGTCAGATCCCACCGCCAACAGAACGATGACCGACATCGCAAGCA
CGAGCCAATGCAGATGCGGATTGCGAGAATATGCTGCCAGAGCAGCACCGATAGTCCGAAAGAGGCACCCAGTGAAAGTGCG
ACTGTGCCCACAATGACGGCGGCGGCAATAAAGGCCCGTGTGATGATCAGCATGATGATAAAAATGAGACAGAGGGACGA
AATTGCCGCGATAAGAAGGTCCCATTGGGCGCCCTCGGAGATGTCGTGGAAGACGGCCGCCGTGCCGGCCAGGTAGATCT
TGGCGTCTTCTAGTGGAGTTCCCTTGAGCGATTCCTCGGCCGCGGTACGAATCGCGTCGATACTTTTGATGCCCTCGGGT
GATTGCGGATCCCCCCTGTGCAGGATGATAAACCGGGCCGCGTGTCCGTCCAAGACAGGAACGACTTCATGGCGCGCTG
GAAGTCTTTGTTCTTGAAAACCTCGGGTGGAAGGTAGAACGAGTCGTCGTTCTTGGCGGCGTCAAAAGCCTTACCCATGG
CTGTGGCATTGTCGCTCATTTCGAGCATCTGGTCGAAGATTCCGGTCATGGTGCTGTGCATGGTAAGAATCATGGTCCGC
ATGTTTTCCATGGCCTCAATCTGCGGCGGGATCTGCGCGACCATTTGTGGCATGAGGCGATCCATCTCGCGCAAGTCGCC
CAAGAGGACGCCTATTTGCTCGCTGAGCTTGTCGATTCCGTCCAGTGCATCGAATATCGATCTGAACGACCAACAGATCG
GAATTCCGTAGCAGTGCTTTTCCCAGTAGAAATAGCTTCGAATTGGTCTCCAGAAATCATCAAAATCCGCGACGTGGTCG
CGTAATTCTTCGGTGATCTCCTTCATCTCTTCGGTGTCGCCGACCATGCGGTGGGTAGTACTGGCCATCTCCGCCATCAA
GCTATGCATCCGCGTCAACACCGCAATCGTCGTGGCCATCTCGTCGGCCTGCTTCAGCATGTCGTTCGCCCGGTCGCGCT
GGTACTTTATGGTCTGCAGCTGACCGGCATTTTGCATGCTGATCTGGAACGGGATCGACGTGTGGTCCATCGTCGTTCCT
TCGGGCCGGGTAATTGCTTGCACACGGGAAATGCCCGGGACCCGGAAGATGCCTTTAGCCAGCTTGTCCAGGACCAGAAA
ATCTGCCGGATTCCGCATATCGTGATCGGATTCAATCATTAGGATCTCGGGCTTCATCCTGGCCTGAGAGAAATGACGAT
CCGCGGCCGCATATCCTTGGTTGGCGGGTATGAAGTCCGGTAGGTAGTCACGGTCGTTGTAGCTGGTTTTGTATCCAGGC
```

FIGURE 7(continued)

```
AGGGCGAGCAGACCGACTAGGGCGATCGCGCAGGTGGCGACGAGAACGGGCAGCGGCCAGCGAACCACCACGGTACCCAC
CCGCCGCCAGCCACGGACTTTGAGGAGCCGCTTAGGGTCGAACAGGCCGAACCGGCTGCCGACGTGTAGGACGGCCGGAC
CCAGCGTCAACGCGACCGCCACTGCGACTAGCATCCCCACCGCGCAGGGGATGCCCAGGGTTTGAAAGTAGGGCATGCGG
GCAAAGCTCAGGCAAAAGGTAGCTCCGGCGATGGTCAATCCAGAGCCCAGAATCACGTGGGCGGTCCCGCGGTACATGGT
GTAGTAGGCGGCCTCTTTGTCCTCGCCGGCTTGGCGGGCTTCCTGGTAGCGCCCGATGATGAATATCCCGTAGTCCGTAC
CGGCCGCGATTGCCAGCGAAGTCAGCAAGCTCACCGCAAAGGTGGTAAGTCCGATAGCCCCGCTATGCCCCAGAACCGCT
ACGACTCCGCGCGCAGCCGTCAATTCGACCCCCACCGTGATCAGCAGGAGAACCACGGTGATTATCGACCGGTAGACGAG
CAACAACATAATAAAGATCACGGCGACCGTAACCATGGTGATCCTGGCCATGGATCTATCGCCACTGTGGTGCATATCCG
CGGCGAGTGCGGATGGTCCGGTCACATAGGCCTTTATGCCCGGCGGCGCGGGCGTGCTTTCGACGATGCTGCGTACTGCC
TCGACGGATTCGTTGGCCAGCGGCGTGCCTTGGTTGCCGGCAAGTGACAGTTGAACATAGGCGGCCTTGCCGTCGTTACT
TTGCACGCCCGCGGCGGTGAGTGGGTCCCCCCATAAATCTTGGACACTTTGCACGTGCTTCTTATCGGCCCTCAATTGAG
CAACCAGGCCGTCGTAATACTTATGGGCAGCGTCGCCAAGGGGTTGGTTACCCTCTATTATGACCATCGCGAAACTGTCG
GAATCGCCTTCCTTGAACACCATGCCGATACGTCCCATCGCCTCAAACGACGGTGCATCCTTGGGACTCAGCGACACCGA
TCGCTCTTGGCCGACAGCTTCCAGTGACGGGACAAATACGGTGACAACGACGCAAACTGCCAGCCAGCCAAGGATGATCG
GTACCGCAAAGGCGTGGATCATCCTGGCGATGAATGGCTTTTCGGGGCGAGCGTTGGTATTGGAGTCGTTCGCGAATTTA
GTACTCACGCGGACTTCACCAAGCAGTAAGTATAGGCGTTGACTTCGTTGGAAACCCTCTCGGCCCTGACCTTGCCGTCT
ACCGTGATTCGGCAGCCAATGCTGTCGCTATTACCTTGTGCCACGATATTTCCCATCACCGCCGTCGTTTGTCGTGAT
ATGCAATGACCACGGTAGCACCGCTCCATCGACCCGTTGCGGCTCGGAATTGACGTCGAAATAACTAATGTCGGCGACTG
TTCCGGGGGGTCCGAAGATCTCGTAAGTCAGGTGTTTAGGGTTGAATGGTTTGCTGTTTTCCAGGTTGGTGTCGGAGTAC
GACGGGCGGTTTTCGGAGCCGAAGAAGCCGCGGATCCGGTGCACGGTGAAGCCCCGACGATGACCACCACCAGGATGAC
CAGTGGAATCCAAGTCCGCATTAGCACCTTGAAAATCTCAGATCCCCTTCACCGGTTGGCAGTGGTACGGCGGACGATAC
CCAACTTTCAAAATCCGTTCGAGCTGGTCGCTACTTGAACGCAACTAAGCCTAGCCTAAGTAAAACATGGTTTTAGGCCC
GAGCTCTCGACTCCTTACCTCGTTCGCTGGAGTGTAACGCATATCACGTGCGTAACGGCACGCTACGTTATCGGCAGCCC
TCTTACAAATCACACGGTGTGCGTTATCCTCTGGCGGTGGCGCAACTCGGCTTCCAGCGCGCCCGCACCGAGGAAAACAA
GCGCCAACGTGCGGCGGCGCTGGTGGAAGCCGCGCGGTCGCTGGCGCTGGAGACGGGCGTGGCATCGGTGACGTTAACGG
CTGTCGCAGGTCGTGCCGGGATTCACTACTCTGCGGTGCGCCGCTACTTCACCTCGCACAAAGAAGTGCTGCTGCACCTC
GCCGCCGAGGGTTGGGCGCGGTGGTCGGGCACGGTATGCGAGCAGCTGGGCGAGCCGGGGCCGATGTCGGCACCGCGGGT
GGCCGAGGCACTGGCCAACGGTCTGGCCGCCGATCCGCTGTTTTGTGATCTGCTTGCCAATCTGCATCTGCATCTCGAGC
AGGAGGTGGATGTCGACCGGGTCATCGAGGTCAAGCGGACCAGCATCGCAGCCGTGATAGCGCTCGTCGACGCGATCGAA
AGCGCATTGCCGGCACTCGGGCGTTCTGGGGCATTCGACATCCTGCTGGCCGCTTACTCGCTGGCGGCCACCCTGTGGCA
GATCGCCAATCCGCCGGAGCGGCTCACCGACGCCTATGCCGAGGAGCCAGAGTTGCTCCCACCGGAGTGGAACCTCGACT
TTGCTGCCGCGCTTACTCGCCTGCTCACCGCTACGCTTCTCGGCCTGCTCGCCGGATCCCCATGCGAATGCCGGTCGCCA
ACGCGCTGAAGCGGGTGCGGGACGAAGGGGGCGCCGGACTTGGGCCCGCTTGGCGGCGGTAGGTGACCAAACTCACGCTT
CTTGGGCGTGCGCCGCAGCCGAACCACGACTATTGCTAGTTGCAAACGATAGTCATAGTCAATTGTTGCCAGACGCACAG
CTGGTGTTGGCGGGAGTCGCCGATAGAGGGAGTGTTCGACATGACGTTGCACGTCGGTGCCGACGGCCTAGAGACCGCAAC
TACGGCGCGCGCCGTGGCGGTCGCTAGGTCCGGAATGGATTGTGTGGCCGGTGATGCGTCAGGGGCGACTTCGTGCCTAC
GCGGTGAGCTATGACGAGCGCACTGATATGCATGGCCTCTCCGCCGGAGGTGCATTCGGCCTTGTTGAGTAGTGGGCCGG
GGCCGGGGCCGGTACTGGCCGCCGCCACAGGGTGGTCGTCACTGGGCGTGAATACGCCGCGGTTGCTGAGGAACTCGGG
GCATTGCTGGCTGCGGTGCAAGCCGGGGTGTGGCAGGGGCCCAGCGCCGAATCATTTGCTGCCGCGTGCCTGCCGTATCT
GTCTTGGTTGACGCAGGCCAGCGCCGACTGCGCCGCGGCGGCTGCCCGGCTGGAGGCGGTGACCGCCGCCTACGCCGCGG
CTTTGGTGGCCATGCCCACCCTGGCCGAGTTGGCGGCTAACCACGCGACCCACGGGGCCATGGTGGCGACCAATTTCTTC
GGGATCAACACCATACCGTCGCGGTCAACGAGGCCGACTACGTGCGGATGTGGCTTCAGGCGGCCACCACGATGGCCAC
CTATCAAGCGGTCGCGGACTCGGCGGTGCGCTCGATCCCGGACAGCGTGCCTCCGCCGCGAATTCTGAAATCCAATGCCC
AATCCCAACACTCGAGCTCGAATAATTCCGGGGGCGGACCCGGTGGACGACTTCATTGCAGAGATCTTGAAGATCATC
ACCGGCGGTCGCGTGATCTGGGACCCCGAAGCCGGCACTGTCAACGGCCTCCCCTATGACGCTTATACCAACCCCGGCAC
ACTCATGTGGTGGATTGCCAGAAGTCTGGAACTTCTTCAAGACTTTCAAGAGTTCGCCAAGCTGCTGTTCACCAATCCGG
TGAAGGCTTTTCAGTTCCTTGTCGACCTCATCCTGTTCGACTGGCCTACACACATGCTGCAGCTGGCTACCTGGCTGGCC
GAGAACCCGCAGTTGCTGGTGGCTGCGCTCACCCCAGCCATCTCCGGACTGGGAGCGGTATCGGGGTTGGCCGGGTTGAC
CGGCCTAGTCCCTCAGCCCCCCGTCGTGCCCGCGCCGGCACCCGATGCCGGTCGTGCCCACCGTGTTGCCACTCGCCGGGA
CGGCCACGCCGACTACCGCGCCGGCCAGCGCCCCGGCCGCCGGAGCGGCGCCCGGGCCCCCGGCCGGTACCGCCACTGCC
ACATCGGCGTCGGTGCCAACGACGCCGGCGGCTTTCCCCCTTACCTCGTGGGCAGCGGTCCAGGCATCGACTTCGACGC
GGGGACGCCCGCCGGTTCCAGGAGAGCGCAGCCCGCCGCCGGGATAACGTCACGGCCGTGGCGGCAGCGCAGGTGTCGGCCC
GTCATCAGGCACGTCGGCGCCGACGAGCGGCGGCGAAGGAACGTGGCAACGCCGACGAGTTCGTCGATATGGACTCCGGC
CCGGCGATTCCGCCGTCGGGCGAGCGGGACGCTTGGGCGTCCAATTCGGGCGTGGGCGGGCTGGGGTTTGCCGGCACCGC
AAGCAACGAGACGGTGGCAGCGCCGGCCGGATTGACCACGCTGGCCGACGATGAGTTCCAGTGTGGCCCACGGATGCCGA
TGCTGCCGGGCGCTTGGGACTTGGGAACTTGGGACCGCGGGGACTGATTACCCTACAACGCAGCGACGTCGCGCATGATG
```

FIGURE 7(continued)

```
TCGGTGGGTTCGCGCACCGGCGCCCCACAGGTCAGGCAGAACGCGCCCGGGGAACGGGTGAGCCGACCGACTTGAAGCAG
GACTTTGGCCTCGACGTGCCACAAGCAGGCAATGCACAGAATTTCGACGGTGTTCCCGAATGGGTCCAGGTCGGGGTCGT
TACATTCGTCTACCGCATGCAGATGCACCACGTAACTCGCCCGGTTGGTGCACCCGGCTCCGGACTGGCAGGTGATTCCA
CCCCAGTCCAGGGCCGCCAGCGTGTGTGGGATCTCGTTGCCGGGCGCTTGACTCATGCGCCGCGCTCCAGTGTCCAGGCC
ATGCGGCCCACGATGTTTACCTCTGCCCCGCAACGGCATGGTATCCCGGCGCGTGGCCGGTGGTGGCTGGGCTACCAAGA
GCGAAGTCGGGCATGGCCTTAGTCCTAGTGGTACGCGATAGGTCGTCGAATTCCGTGGGTGATGGATATGACTATTTCGT
AGCTGGTCGCCAGAATCAATCCGCCGAACGGCGGCTGATGGGCCCAACGGGCTGTCCCCCGAATGGTGGACAACATTTCC
GGGTTCGTTGCAAACGACCGCGCTTTGACGCCGGTTAGCTTTAGGCCGGACTTAGGCCCAGTTCCACACCGACATGTCGC
CGGCTGGGTATCCATTGCACACCTCGGTCCCTTTAGCGACGACGCCCTTGTTGTTGAAGAAGATTTTCATGTGATTGACC
CAGGCAAACGTCAGCGGATCGCCATTGTAAAAGTGTTCGGAGTAGTCTCGGCGCTCCGCCGGTGACAGCGAGAAGAACCA
GTGCGCCTTGTTGATCGTCGCTTGCTGAAGGTTTGCATGGTTGTTGAAGTCGATCATGTACCGCTGGTAGTACACCGGAC
TGGTATCCCGCACCGCCGCCAGATATTGTTCGGCGTCGCAGGTGGTTGCGATCATCCGGCGAGGTATTGGAAAGTCTTCC
GTGGAGTCGGCTGCCGCGCTTTGTGGAAATGTCGCAGCGGCGATGCCGAGAACCAGAAATGCCGCGCCGGCACGCAGGAT
GGAACTCAGCCGAGACATAGTGGTTACCGTAGCACTTTTGGGGCGCCTCGAGGCGGGCAGACGACAAGGTTCATAGTCTG
TCTCACTACATGCTCCCATCAGGAGTGATGACGTGCGTGGGGTCGGGTCGCAGTTCCGGTGGGGCTTGGCTGTAGTCGCC
GAACGGGCCGTCGCGGCGCTCGACCGCGGCTCGCACACCCTGGGTTTGGGCGGTCCGGATGAACTCGAGCGCGTCGGGGG
TGTTGCGCATCAGCCCGTCGAGAATGCCGCCCAGCAGCTGGGTGGAGGCCAGGCCCATGTTCTCGTAGGCCTGGTTGACG
ATCAGTTTCTGGGCTTGCAACTGTGACAACGGGATTCGTGCCAGCTCGGTGGCGATCTCGGCGACGCGAGCCTCGAGCCG
CTCGAACGGCACCGCCTCGTTGATCAGCTCGGCTTCGGCGGCCTGCACACCGGTCAGCGGCCGGCCCGTCAGCGAGTGCC
ATTTGACCTTGGCAAGGCTGAGTCGATACAGCCACATCCCGGTCAAATAGGCTCCCCACATGCGGCTATACGGAGTCCCG
ATCACGGCGTCCTCGCTGGCGATCACAATGTCGGCACACAGCCGCGTAGTCGCTGGCCCCGCCGACGCACCAACCATGCAC
TTGCGCGATCACCGGTTTGGACGCCCGCCAGATGGCCATGAATTTCTGCTCGGTCCGGTCTCCCGCGCGGTGACCATGG
CGAAATCCTTGCCCGGATCCCATCGGCCGTCGGTCATCATGGCATCGCCCCAATGCTGGAAGCCGCCGCCGAAGTCGTAA
CCGCCGGAGAAGGCGCGGCCGGCACCGCGCAGCACGATGACCTTGATGTCCTGGTCGCGCTCGGCCAACCCGATAGCGGC
CTCGATCTCGTCGGGCATGGGCGGGACGATGGTGTTGAGCTGTTCCGGGCGGTTGAGCGTGATGGTGGCCACCGGCCCGG
CCGTCGTGTACAGCAGCGTCTGGAAATCGGGTGTCGGCATAGCAGCAGCGAAGTCACTTCGGCCCTAAGGGTCAAGTGTC
TCAGCGGGGATCGTGATAACGCCGCTGGTTCGAAGCTTCGGCAACCCGGGCGCAGGGTTTCGCTAGCTGGCATTTGCAT
GCCTCGGGCATCGGTGCTCCGGTTGCGCTCTTTGCTCCGACGTTAGCCGCAGGGCCCTGCGGCTAGGCGCGGCCGGTGCCG
TTGGCCGCGGCGGCAATCGATGTTGCAGCAGTTACAACGCCAAATGGAGTCTGAGCGCATCGTCGAGTTCGATCAGCTCG
GCAGGGGAGACGTTGCGCAGCGACGGATCCAACCTGCTGGGCCTGCGCCTTCGAATCGACGGCCAGGCCACCGCTCGCTG
CCGGCAACAACACCTGGAATGGGGACCTTTTCGGTGTTGCTGGTAACCGGGACAACCGGCACCACGCCTCGGTCGAGACG
TATCGCGGCAGCGTTGGCCCTGTCGTTGCTGACAATTACCGCTGGCCGCCGCATATTTGCCGCGCTGCCGCGGGCCGGAT
CCAGGTCGACCTGCCAGATCTCACCGCGCAGCATCTACGCCGTTCGCTGCAAACCGCCGACTGCGACGGCAGGCCCACTC
TCTTGGCATGCGTCCAATGCTGCGACGTCCTCGGTAGACAGCTCACGCTTGGCTTCATGCCGCAGTCCTACCCATGTAG
TAACAGATAGTAATACGTAGTAATAGGTAGTAATGCAGTATCAATCGGCTACAACTCGATAGCCACGTTATTTGGGCTAA
GTCCACCGTTCGTGAATGCCGGTTAGCCGGCCAGCATCCGCCATAGGAACGCGAAACTCAGCGCCGATTTGAATGCGATC
TGTGCGTTGTCGGCTGCGCCGGCGTGCCCACCCTCGATGTTTTCGTAATACCAGACGGGGTGGCCCGCAGCCTGCAGGGC
CGCCGTCATTTTGCGGGCGTGGCCGGGGTGCACCCGATCGTCGCGGGTAGAGGTCGTCATGAGTACTGGCGGGTATTTCC
GGTTCGCCGAAATGTTTTGGTATGGCGAATATTCAGAGATGAACTTCCAGTCATCCGGGTTATCCGGATCGCCGTATTCG
GCCATCCAGGAAGCGCCGGCCAGCAGCAGGTGGTACCGCTTCATGTCCAGCAGCGGCACGTCGCAGACCAGCGCGCCGAA
CTTCTCCGGGTACCCGGTCAACATGATGCCCATCAGCAGCCCACCGTTGCTGCCGCCCCGCGCGCCGAGCTGCTCAGCGG
TGGTGATGCCGCGGGTCACCAAATCGGTTGCCACGGCGGCGAAGTCTTGGGCGACCTTGTCCCGGCCCTCGCCGCATCGCC
TGCGTGTGCCAGCCAGGCCCGTACTCGCCGCCGCCGCGGATGTTGGCCAACGCATAGGTGCCCCCGCGGGCCAGCCACAG
CCGGCCCAGGACGCCGTCATACGTCGGCGTTCTGGATGTCTCGAATCCACCGTAGCCGTTCAACAATGTGGGCCGGGAT
TGTCCGCGTCGGTGCGTCGCACGACGAAATACGGGATCGATGTGCCATCGTCTGATGTCGCGAAATACTGTGTTACAGCC
ATGTTTTCCGCGTCGAAGAAAGCTGGCGCAGATTTGATCTCTGCTAGTCGGCCGTCATCGGTGCCGCGCATCAGCCGCGA
CGGCGTATCGAATCCACTGGAGTCGAGGAAGAACTCGTCGCCGTGGCTGTCGGCGGAGACGATGACGGTGTTGGTGGCGG
CGGGGATACCTGAGAGTGGCTCACGTCGCCAGCTGCCGGGAGTTGCGATCTCGACGCGGCTCGCCACGTCGGCCAGGGTG
ACGATCAACAGCCGGTCTCGGGTCCAGGCGTATTGGTACGGCGGTGTGCTCGTCGGGTTCGAACACCACCTGTAATTC
CGCTGAGCCGGCAAGGAATTCGTCGTATTCGGCGGCCAGCAGTGAGCCGGCAGTGTACCTGGTGGTGGCCACGGTCCAGT
CGGTGCGCAGCTCGATCAACAGCCAGTCGCGGTGAATTGACACGCTCGCGTCGGTGGGGCTTCGATTCGGATCAGCTCC
GAACCACGCAATTCGTAGACCTCTTCGTTCCAGAAGTCGAGGGCCCGTCCCAGCAGGGTGCGCTCGAATCCGGGCGTGCG
ATCCGCTGACGCGTTGACGCGGACGTCGGTGCCCGCGCCCTCGAAGATTGTCTCCGCATCGGCCAGCGGTTTGCCCCGGC
GCCATCGCTTGATCACTCGCGGATAGCCGGAAGTGGTGAGCGAGTCGCCGCCGAAGTCGGTGCCCAGCAAGACAGTGTCC
GGGTCCTCCCAGGTAATCTGGGATTTGGCCGGTGGCAGCTGGAACCCATCCTCGACGAATTCGCGTGTCAGCATGTCGAA
TTCACGCACAATGGATGCATCCGAGCCGCCCGGGACAGGCCGATCAGCGCGCGCGTGTAGTCGGGTTCGATGACACCGG
```

FIGURE 7(continued)

```
CGCCGCCCCACACCCACTTCTGGTCGTCGGCGCGGCCCAGTTCATCAACATCGATCAGCACATCCCAGCCCGGCGAGTCG
GTGCGGTAGCTGTCCAGCGTGGTGCGCCGCCACAACCCGCGGGGGTTGGCGGCATCGCGCCAGAAGTTGTAGAGATAGTT
GCCGCGCCTGTTCACATAGGGGATTCGGGCATCGGTGTCGAGCACCTCGAGCGCCTCGACGCGCATCCGCTCGAACTCTG
CGTCGCAGAACGCCGCCGTTGTCGGCTTGTTGCGCGCGCGTACCCAATCCAGCGCTTCCGCACCGGTGACGTCCTCGAGC
CATAGGTAGGGGTCAGCGCCGTCTGGGGCAGGCTCAAATGTCATGGAAGCCATTGTGGCCCCGGCGGTAGTGTGAGCTGT
ATTACATGATTTTGACGAGGAGCCGAATACGATGACTGTCTTTTCCCGTCCCGGTTCCGCCGGGGCGCTGATGTCCTATG
AATCCCGGTACCAAAACTTCATCGGGGGCCAGTGGGTCGCGCCGGTCCATGGGCGCTACTTCGAGAACCCGACGCCGGTG
ACCGGCCAGCCGTTCTGCGAGGTGCCGCGCTCCGACGCGGCCGACATCGACAAGGCGCTCGACGCCGCGCACGCGGCGGC
GCCGGGGTGGGGCAAGACCGCACCGGCCGAACGGGCGGCGATCCTCAACATGATTGCCGACCGCATCGACAAGAACGCCG
CCGCGCTGGCCGTGGCCGAGGTCTGGGACAACGGGAAACCGGTCCGGGAAGCGCTGGCCGCCGATATCCCGTTGGCGGTC
GATCACTTCCGGTACTTCGCCGCCGGCGATTCGCGCCCAGGAGGGCGCGCTGAGCCAGATCGACGAGGACACCGTGGCCTA
CCACTTCCACGAGCCGCTCGGCGTGGTGGGCCAGATCATTCCGTGGAACTTCCCCATCCTGATGGCGGCCTGGAAGCTGG
CGCCGGCGTTGGCGGCCGGCAACACGGCGGTGCTCAAACCCGCCGAGCAGACACCCGCTTCGGTGCTCTACCTGATGTCG
CTGATCGGTGATCTGTTGCCGCCCGGGGTGGTCAACGTGGTCAACGGATTCGGCGCCGAGGCCGGCAAGCCGTTGGCCTC
CAGCGACCGCATCGCCAAGGTCGCGTTCACCGGGGAAACCACCACGGGGCGGCTGATCATGCAATACGCCTCGCACAACC
TGATCCCGGTCACCCTGGAACTCGGCGGCAAGAGCCCCAACATCTTCTTCGCCGACGTGCTGGCCGCCCACGACGACTTC
TGCGACAAGGCGCTGGAAGGCTTCACCATGTTCGCCCTCAACCAGGGCGAGGTGTGCACCTGCCCGTCGCGCAGTCTGAT
CCAGGCCGACATCTACGACGAGTTCCTGGAGCTGGCGGCGATCCGGACCAAGGCGGTCCGGCAGGGCGACCCGCTGGACA
CCGAAACCATGCTGGGTTCCCAGGCCTCCAACGACCAGCTGGAAAAGGTGTTGTCCTACATCGAAATCGGCAAGCAAGAG
GGTGCGGTGATTATCGCCGGAGGCGAGCGCGCCGAACTAGGCGGCGACCTGTCCGGCGGTTATTACATGCAGCCGACGAT
CTTCACCGGCACCAACAACATGCGGATTTTCAAGGAGGAGATCTTCGGGCCGGTGGTCGCGGTGACGTCGTTCACCGATT
ACGACGACGCGATCGGCATCGCCAACGACACCCTCTACGGCTTGGGTGCCGGTGTGTGGAGCCGCGACGGCAACACTGCC
TATCGGGCCGGGCGGGACATCCAGGCCGGCCGGGTGTGGGTCAACTGCTACCACCTCTACCCCGCGCACGCGGCGTTCGG
CGGCTACAAGCAGTCCGGCATCGGCCGGGAGGGCCACCAGATGCTGTCGCAGCACTACCAGCACACCAAGAACCTGCTGG
TGTCCTACTCGGATAAGGCGCTGGGGTTCTTCTGATGAACGCTCCCGCGGGGGTGCTCATCACCGCCGAGGCCGCCGCGC
TGCTGGCTGGGTTACAGGACCGGCACGGTCCGGTGATGTTCCACCAATCCGGCGGCTGCTGCGACGGGTCCGCGCCGATG
TGCTACCCGCGGGCGGACTTCCTGGTCGGTGACCGCGACATCTTGCTGGGTGTGTTGGACGTCGGGGAAGACGGCGTGCC
GGTGTGGATTTCGGGCCCGCAGTACCAGGCCTGGAAGCACACCCAGCTGATCATCGACGTGGTGCCGGGCCGCGGTGGCG
GGTTCAGTCTGGAAGCGCCCGAGGGCGTGCGCTTTCTCAGCAGAGGTCGGGTGTTCAGCGACGCCGAAAAGGCGATGCGG
GAGGCTGCGCCGGTGATCACCGGCGCAGCCTACGAGTGCGGCGAACGACCGTTAGTGCGGGGTCTTGTCGTCGATCTCGA
CGATCCAGATGCCACGCGGGAGTGTGCCGCGCCAGTCGGCGGTAGCCGCAGTAAGGTCGTAGACCGTGATCCCCCTTCC
GCGGTCATGGCAGCTGACCAGCGCGATGCTGGTTGGTAATGCGATCGGACTGCTAGCGGGGGTGGCGTGCAGCGTGCTGG
TGCATGCCCGGATCCGTCCGGACATCGTCATCGCAATGGTAGTCGGGATTCCCAGCGCGATCGGGCTGCTGGTCATCCTG
TTCTCCGGACGTCGATGGGTGACGATGCTGGGCGCGTTCATCCTGGCGTTGGCGCCCGGGTTGGTTTGGTGTGCTGGTTGC
GATCCAGGTGGCGTCCAGTGGCTGACAACGATTACCGGTCGGCACCCGGAACCGAGCCGTTTGTGCCCGATTTCGACACC
GGCGCACACTCGCAGCGGTTCCTCTCGTTGGCCGGCCAGCAAGACAGGCGCGGGAAATCCTGGCCAGGCTCGACGCCGAA
GCCGCAGGAGGACCCCGTGGGTGTCGCGCCTTCGGCCAGCGTCGAGGTGCTGGGGTCCGAGCCGGCCGCCACGCTAGCGC
ACTCGGTTACAGTACCCGGTCGATATACCTACCTGAAGTGGTGGAAGTTCGTTCTAGTGGTCCTCGGCGTATGGATCGGT
GCTGGCGAGGTCGGCCTGAGCTTGTTCTACTGGTGGTATCACACACTCGACAAGACGGCCGCCGTGTTCGTCGTCCTGGT
CTACGTCGTCGCGTGCACCGTCGGTGGCTTGATCCTGGCGCTGGTGCCGGGCAGGCCACTGATCACGGCGTTGTCCCTCG
GAGTGATGTCGGGGCCGTTTGCCTCGGTCGCCGCCGCGGCGCCGCTCTACGGCTACTACTACTGCGAGCGGATGAGTCAT
TGCCTGGTCGGCGTCATTCCGTACTAGTCGGTTGTCGGACTTGACCTACTGGGTCAGGCCGACGAGCACTCGACCATTAG
GGTAGGGCCGTGACCCACTATGACGTCGTCGTTCTCGGAGCCGGTCCCGGCGGGTATGTCGCGGCGATTCGCGCCGCAC
AGCTCGGCCTGAGCACTGCAATCGTCGAACCCAAGTACTGGGGCGGAGTATGCCTCAATGTCGGCTGTATCCCATCCAAG
GCGCTGTTGCGCAACGCCGAACTGGTCCACATCTTCACCAAGGACGCCAAAGCATTTGGCATCAGCGGCGAGGTGACCTT
CGACTACGGCATCGCCTATGACCGCAGCCGAAAGGTAGCCGAGGGCAGGGTGGCCGGTGTGCACTTCCTGATGAAGAAGA
ACAAGATCACCGAGATCCACGGGTACGGCACATTTGCCGACGCCAACACGTTGTTGGTTGATCTCAACGACGGCGGTACA
GAATCGGTCACGTTCGACAACGCCATCATCGCGACCGGCAGTAGCACCCGGCTGGTTCCCGGCACCTCACTGTCGGCCAA
CGTAGTCACCTACGAGGAACAGATCCTGTCCCGAGAGCTGCCGAAATCGATCATTATTGCCGGAGCTGGTGCCATTGGCA
TGGAGTTCGGCTACGTGCTGAAGAACTACGCCGTTGACGTGACCATCGTGGAATTCCTTCCGCGGGCGCTGCCCAACGAG
GACGCCGATGTGTCCAAGGAGATCGAGAAGCAGTTCAAAAAGCTGGGTGTCACGATCCTGACCGCCACGAAGGTCGAGTC
CATCGCCGATGGCGGGTCGCAGGTCACCGTGACCGTCACCAAGGACGGCGTGGCGCAAGAGCTTAAGGCGGAAAAGGTGT
TGCAGGCCATCGGATTTGCGCCCAACGTCGAAGGGTACGGGCTGGACAAGGCAGGCGTCGCGCTGACCGACCGCAAGGCT
ATCGGTGTCGACGACTACATGCGTACCAACGTGGGCCACATCTACGCTATCGGCGATGTCAATGGATTACTGCAGCTGGC
GCACGTCGCCGAGGCACAAGGCGTGGTAGCCGCCGAAACCATTGCCGGTGCAGAGACTTTGACGCTGGGCGACCATCGGA
TGTTGCCGCGCGCGACGTTCTGTCAGCCAAACGTTGCCAGCTTCGGGCTCACCGAGCAGCAAGCCCGCAACGAAGGTTAC
```

FIGURE 7(continued)

```
GACGTGGTGGTGGCCAAGTTCCCGTTCACGGCCAACGCCAAGGCGCACGGCGTGGGTGACCCCAGTGGGTTCGTCAAGCT
GGTGGCCGACGCCAAGCACGGCGAGCTACTGGGTGGGCACCTGGTCGGCCACGACGTGGCCGAGCTGCTGCCGGAGCTCA
CGCTGGCGCAGAGGTGGGACCTGACCGCCAGCGAGCTGGCTCGCAACGTCCACACCCACCCAACGATGTCTGAGGCGCTG
CAGGAGTGCTTCCACGGCCTGGTTGGCCACATGATCAATTTCTGAGCGGCTCATGACGAGGCGCGCGAGCACTGACACCC
CCCAGATCATCATGGGTGCCATCGGTGGTGTGGTTACCGGCTACATCCTCTGGCTGGCGGCGATCTCCGTCGGCGATGGT
CTGACGACGGTGAGTCAATGGAGTCGCGTGGTGTTATTGCTGTCGGTCCTGGTGGCGGTGTGCGGCGCGGCGGGCGGCTT
GCGGCTGCGCAGCCGCGGCAAGCTCGCGTGGTCGGCGTTTGCTTTCAGTTTGCCGATTCCTCCCGTGGTGCTGACCGTGG
CGGTGCTGGCCGACATCTACCTTTGACGGCTACTGTGGGTTGTCCGGCGGGATGGCCAGGGCGGTGATCGTTGCGGCGAT
CGCGTCGTATTGGGTTGCGAGTAAACAGAATTCGATCAACAGGCGCGGATCGAGGTGAGTTGCCAGCCGCTCCCAGGTGC
CCGCGGTGATCGTGCGATCCTTGATCAATTCATCGGTAGCCTGTAGCAGCGCCTGTTGGCGGGCGCTGAGCACTTTTCGC
GGTCCGTCTCCATCTGGAACGTCGGGCCAGGCGAATATCGTGGCCTGGGTGTTGGCGTCTAGGCCCCGACGGCGCGCCAT
TCGGCGATGATGCTGAAGTTCGTATTCGCAAGATCGTAGGTGTGCGACCCGAAGGATCACCAACTCGGTATCGACGCCGG
GCAGCCGCCCGTGCAGTAGTCGGCCGGTGTAGATGGCAAAGGTCCAGAACAAGTACTGGCGGTAGCCCAGCGTGGTGAAC
AGGTGCATCTGCGGTGCCCCAACCGCACGTGCGGCCAGCTTGGCCACCAGCCAGTTGACCGGCCCCAGCTGGCGGAACTT
CCCCGGGGAGATACGCGCGACTTGGCCGTTCTGACCGGTCATAGTTGTTTCACCAGATACGGGGACACCGTGCTGCGGTG
TTCGTCGAGATCCAGTGCCCGCCCCAAGGCGGGGAAGGCGCGTTGCGGACAGTTGTCGCGTTCGCAGACGCGGCAACCGG
CGCCGATAGGTGTGGCCGCAGTATTCGGGTCACCCGACAAGTCGAGTCCTTCCGAGTAGACGAGCCGGTGCGCGTGGCGA
AGTTCGCAGCCCAGCCCGATCGCGAAGGTCTTACCGGGCTGACCATACCGGGCGGCCCGGAGCTCAACGGTGCGGGCCAC
CCACAGGTAGTTGCGGCCGTCGGGCATCTGGGCGATTTGCACCAAGATCTTCCCGGGTTGGCAAACGTTTCGTAGACGT
TCCACAGCGGGCAGGTGCCGCCGCTGGAGGAGAAGTGAAAGCCGGTGGCCGACTGACGTTTTGACATGTTTCCCGCTCGG
TCCACCCGGACGAAGGTGAACGGGACCCCGCGCATCGAAGGCCGTTCTAGTGTCGACAGCCGGTGGGCGATGGTCTCGTA
GCTCACCGAGTAGAACGCCGACAGCCGCTCGACGTCGTAGCGGGAAATTCTCGGCGACGTCGTGGAACTGGCGGTAGGGCA
GCACGGTGGCCGCGGCGAAGTAATTAGCCAGGCCCAGCCGGGCCAACGTCCGCGACTCGGCGCTGGTGAACTTGCCGTCG
GTGACCATGGCGTCGATGAGGTCGCCGAACTCGAGATAGGCCAACTCGGCGGCCATCTTGAACACCTGCTGGCCCGGGGA
GAGGTGACTGCTGATCTCCAGCGTGTTGGTCGCGGGGTCGTAGCGGTGCAGCACGGTGTCACCGAGGTCGATGCGCTTGT
TGATGCGTACTCCGTGCACCTCGGTGAGCCGGCGGGTCAATTCGCGGGCCAGGTCGCCGTGGTGCATCCGCATCTGGGCC
GTGAGGTCTTCGGCCGCGGTGTCCAGCGCATGTAGATAGTTCTGGCGTTGGTAGAAGTAGTCGCGCACCTCTTCGTGCGG
CATGGTGATCGACCCTCGGCCACTGCCGTCGGAGAACCGCTCCTCGGTCGCGGCGGCCAGCTGCGCGGTGGTGATCCGGT
AGCGCCGATGCAGGTTGACCACCGCGCAGGCCAGCCCGGGATGGAGCGCTGACCATTTCGGCCACTTCATCGCGGGTCGATG
GCGATGTCTAGATCGCGGTCCAGGGTCACCTCCCTGAGTTCGGCAACCAGCCGGGTGTCGTCCTGGGAGGCAAAGAACGT
CGCGTCCACCCCGAACACTTCGGTGATGCGCAGCAGCACGGCCACGGTCAGCGGCCGGACGTCGTGTTCGATCTGGTTCA
GATAGCTCGGCGAGATCTCCAGCATCTGGGCCAGCGCGGCCTGGCTGAACCCGCGCTCGTTACGCAGTTGGCGGACCCGC
GAGCCGACGTAGGTCTTGGACACCCAACCGAGCGTACCGGGTGTTGTGAAGACGCCATTCGCAGAGTTAGCAAGCGTGCT
GCGATTGGTGTTTCCGCCACGGCGTTGGCATGATTCGCACCGGGACTCAAGGGTGAGCCTGAGGTACACGCGAGGAGGAA
ATGGGGAGAACGCCGTGAGCCTCGACAAAAAATTGATGCCCGTGCCCGACGCGTCACCCCGACGTGTTCGACCGAGAATGG
CCGCTGCGCGTCGGCGACATCGACCGCGCGGGCCGGCTGCGGCTGGACGCGGCTTGTCGGCACATCCAGGACATCGGTCA
GGACCAACTGCGCGAGATGGGCTTCGAGGAGACCCACCCGCTGTGGATCGTCCGCAGGACCATGGTGGACCTTATCCGGC
CGATCGAGTTCGGCGACATGCTGCGGTGTCGGCGCTGGTGCTCGGCACCTCCAACCGGTGGTGTGAGATGCGAGTTCGT
GTCGATGGCCGCAAGGGCGGCCTGATCGAATCCGAGGCGTTCTGGATCCACGTCAACCGGGAAACCGAGATGCCGGCCCG
CATTGCCGACGACTTCCTCGCGGGTCTGCACCGGACCACGTCTGTTGATCGGCTGCGCTGGAAGGGCTATCTGAAGCCGG
GCAGCCGGGATGATGCGTCGACATCCACGAGTTCCCGGTCCGGGTCACCGATATCGACTTGTTCGACCACATGAACAAC
GCTGTCTATTGGAGTGTGATCGAGGACTACCTGGCGTCGCATGCAGAGCTGCTGCGGGGCCCTTTGCGGGTGACCATCGA
GCATGAGGCGCCGGTTGCGCTCGGCGACAAGCTGGAGATCATCTCCCACGTTCACCCGGCTGGTTCGACCGAGATATTCG
GCCCGGGGTTGGTCGACCGCGCTGTTACAACGCTCACATATGTGGTTGGCGACGAGCCCAAGGCAGTCGCCTCGCTGTTC
AATCTGTGACCGGATCCGCAGGACGTCGATCCGTGGGTTTACCTGCGGATTTGTCGTTACTGGCGGGTAGCTTCTGAAAC
GGTTCAGTTTTTGGGCGACTTCGCAAAATTTGCAAAAAGTCCGCAGGCCGTTGCCGAAATTCGCAAGTGAAATGGGTGGA
CCAGCGTTGACACGCTGTGCCATGGTCGAGTTAGCACACCAGTGAAGCTGCGCCGTTGACACCGCCTGGACGACGGTAGG
GCGTCAGCGTTTTCGGCAATGAAAGACCGTTAAGGAGTTGTCTATGTCTGTCGTTGCGCACCCCGAAGAGCGCGGAGCAGA
TCCAGCAGGAATGGGACAACGAACCCGCGCTGGAAGGACGTCACCCGCACCTACTCCGCCGAGGACGTCGTCGCCCTCCAG
GGCAGCGTGGTCGAGGAGCACACGCTGGCCCGCCGCGGTGCGGAGGTGCTGTGGGAGCAGCTGCACGACCTCGAGTGGGT
CAACGCGCTGGGCGCGCTGACCGGCAACATGGCCGTCCAGCAGGTGCGCGCCGGCCTGAAGGCCATCTACCTGTCGGGCT
GGCAGGTCGCCGGCGATGCCAACCTGTCCGGGCACACCTACCCCGACCAGAGCCTGTATCCCGCCAACTCGGTGCCGCAG
GTGGTCCGCCGGATCAACAACGCACTGCAGCGCGCCGACCAGATCGCCAAGATCGAGGGCGATACTTCGGTGGAGAACTG
GCTGGCGCCGATTGTCGCCGACGGCGAGGCCGGCTTTGGCGGCGCGCTCAACGTCTACGAGCTGCAGAAAGCCCTGATCG
CCGCGGGCGTTGCGGGTTCGCACTGGGAGGACCAGTTGGCCTCTGAGAAGAAGTGCGGCCACCTGGGCGGCAAGGTGTTG
ATCCCGACCCAGCAGCACATCCGCACTTTGACGTCTGCTCGGCTCGCGGCCGATGTGGCTGATGTTCCCACGGTGGTGAT
```

FIGURE 7(continued)

```
CGCCCGTACCGACGCCGAGGCGGCCACGCTGATCACCTCCGACGTCGACGAGCGCGACCAGCCGTTCATCACCGGCGAGC
GCACCCGGGAAGGCTTCTACCGCACCAAGAACGGCATCGAGCCTTGCATCGCTCGGGCGAAGGCCTACGCCCCGTTCGCC
GACTTGATCTGGATGGAGACCGGTACCCCGGACCTCGAGGCCGCCCGGCAGTTCTCCGAGGCGGTCAAGGCGGAGTACCC
GGACCAGATGCTGGCCTACAACTGCTCGCCATCGTTCAACTGGAAAAAGCACCTCGACGACGCCACCATCGCCAAGTTCC
AGAAGGAGCTGGCAGCCATGGGCTTCAAGTTCCAGTTCATCACGCTGGCCGGCTTCCATGCGCTGAACTACTCGATGTTC
GATCTGGCCTACGGCTACGCCCAGAACCAGATGAGCGCGTATGTCGAACTGCAGGAACGCGAGTTCGCCGCCGAAGAACG
GGGCTACACCGCGACCAAGCACCAGCGCGAGGTCGGCGCCGGCTACTTCGACCGGATTGCCACCACCGTGGACCCGAATT
CGTCGACCACCGCGTTGACCGGTTCCACCGAAGAGGGCCAGTTCCACTAGTCTGCCGAGCAGACGCAAAAGCACCCTTTT
GCGGCGCAAAAGTGGCGCTTTTGCGTCTGCTCGCGCATTTGAGGAGGAACAGTGAGCGATGCGATCCAGCGGGTAGGGGT
TGTCGGGGCCGGGCAGATGGGGTCCGGCATCGCCGAGGTCTCCGGCTCGCGCCGGCGTCGAAGTGACGGTGTTCGAGCCGG
CCGAGGCGTTGATCACCGCGGGACGCAACCGCATCGTGAAGTCGCTGGAGCGGGCCGTCAGCGCCGGCAAGGTAACCGAG
CGCGAGCGTGACCGCGCCCTCGGCCTGTTGACCTTCACCACCGACCTCAACGACCTATCCGATAGGCAACTGGTGATCGA
GGCCGTTGTCGAGGACGAGGCCGTCAAGTCCGAGATCTTCGCCGAGCTCGACCGGGTCGTCACCGATCCGGACGCGGTGC
TGGCGTCGAATACCTCCAGCATCCCGATCATGAAGGTCGCCGCGGCCACCAAGCAGCCGCAACGGGTTCTTGGCCTGCAT
TTCTTCAATCCGGTCCCGGTGCTGCCGCTGGTCGAGTTGGTGCGCACGCTGGTCACCGACGAAGCCGCCGCCGCGCGCAC
GGAGGAGTTTGCCAGTACTGTGCTGGGCAAACAGGTCGTGCGTTGCTCCGACCGCTCCGGATTCGTGGTCAATGCGCTCC
TGGTGCCGTATTTGCTGTCGGCGATTCGGATGGTCGAGGCCGGGTTTGCCACCGTCGAAGATGTCGACAAGGCCGTTGTT
GCGGGGTTATCGCACCCGATGGGTCCGCTGCGGCTTTCCGATCTTGTCGGCCTAGACACCCTCAAGCTGATCGCGGACAA
GATGTTCGAAGAATTCAAAGAACCGCACTACGGGCCCCCTCCGCTGTTGCTGCGTATGGTTGAGGCGGGCCAGTTGGGAA
AGAAATCGGGTCGAGGTTTCTACACGTACTGAAGTGTATGAACGGCCCCCAGGCTTGACGCAAGGCGAGATCACAGACCG
AGACGGTGTGGTTACGATCGTGTGACAGCCGTTGCGTACATCGGGTAGTATTTCCGCGATCAACAGATGAGAGGTTCGGC
CGGCATGACTGAGTTAAGGCCCTTTTACGAAGAGTCGCAATCGATTTACGACGTTTCCGACGAGTTTTTCTCACTGTTTC
TAGACCCCACGATGGCTTACACCTGCGCGTACTTCGAGCGTGAGGACATGACTCTCGAAGAAGCGCAAAACGCGAAGTTC
GATTTGGCGCTGGACAAGTTGCATCTTGAGCCCGGGATGACGCTGCTCGATATTGGCTGCGGCTGGGGTGGTGGGCTGCA
ACGAGCGATCGAGAACTACGATGTGAACGTCATCGGTATCACGCTCAGTCGCAATCAGTTCGAGTACAGCAAAGCGAAAT
TGGCGAAAATTCCCACCGAACGCAGCGTCCAGGTGCGGCTGCAGGGCTGGGATGAGTTCACGGACAAGGTCGACCGTATT
GTCAGCATCGGTGCCTTCGAAGCATTCAAAATGGAGCGTTATGCGGCATTCTTTGAGCGTTCCTACGACATACTTCCAGA
TGACGGCCGGATGCTGCTGCACACAATTCTGACCTATACGCAGAAGCAGATGCATGAGATGGGCGTCAAGGTGACGATGA
GCGATGTGCCGGTTTATGAAATTCATCGGCGAAGAAATTTTTCCGGGCGGACAGTTACCGGCGCAGGAAGACATCTTCAAA
TTTGCGCAGGCGGCGGACTTTTCGGTGGAGAAGGTGCAATTGCTGCAGCAGCATTACGCTCGGACGCTAAACATCTGGGC
GGCGAATCTGGAGGCTAACAAGGACCGCGCCATTGCTCTTCAGTCCGAGGAGATTTACAACAAATACATGCACTATCTGA
CCGGATGTGAGCACTTCTTCCGCAAGGGCATCAGCAACGTGGGACAGTTCACACTGACCAAGTAGCCCATCGCCGCCCGA
GCACCCCAGGGGTTGCGGAGCTCACGCCGGGTGTGGCTTGACGCCCGGGCACCGGCCGGTGGGTAGCCAGCGCGCTTTGT
CCGGTTACTTTTCCAGTGTGAACTGGTCGACGTCGGTGTAACCCTGGCGAACAGCTTCGCGCAGCCGGTCAGGTACTTC
ATGTAGCGGTCGTAGACAGTCTGCGACTGGATCGCGATGGCCTGATCTTTGTTGGCCTCGAGCGCTGTGGCCCACATGTC
CAGCGTCCTGGCGTAGTGCAGCTGCAATGACTGGACCGCGGTGACCCGGAAGCCGACCTTCTCGGCGTACTCGTGCACCG
TCGGGATGGACGGCAGCCAGCCACCGGGGAAGATCTCGGCCAGGATGAATTTGGTGAAGTGAACCAGTTCGTGGGTCAAC
GTCAGGCCCTTTTCCCTGCCTTCTTTGAAGGTGGGGCGCACGATGGTGTGCAGCAACATCTTGCCGTCGGCCGGCAACGT
GCGGTGGGTCACCTCGAAGAAATGGTGGTAGCGCTGGTGGCCGAAGTGCTCGAACGCGCCGATCGAGACGATGCGGTCGA
CGGGCTCGTCAAATTTCTCCCATCCCTCCAGCAACACTCGTCTGGAGCGGGGGGTGTCCATTTGGTCGAACATTTTCTGG
ACATGACCGGCCTGGTTCTCCGACAACGTCAGGCCCACGACATTGACGTCGTATTTCTCGATGGCGCGCCGCATGGTCGC
GCCCCAGCCGCAGCCGATGTCCAGCAACGTCATCCCGGGTTCGAGGTTCAGCTTGCCCAGGGCCAGGTCGATCTTGGCGA
TCTGGGCCTCCTGCAGCGTCATGTCGTCGCGTTCGAAGTAGGCACAGCTGTAGGTCTGGGTGGGGTCCAAGAACAGCCGG
AAAAAGTCGTCGGAGAGGTCGTAATGAGCTTGCACGTTTCCAAAATGCGGCGTGAGCTGCACGGACATACCCGATTGAGCC
TTTCTGTGTTCCGAGGCCCGCATCCGCTTGCCTCGACGCACCCCTGATCTATCCCCGATGCATCCCTTGCATGCTAGCTG
CTGAAAGGCGGCCCAGTCGCAATCGGCGCCATGACCAGCTGTCGCAGCCGTCAGCGAAAATCACCAGGCGCGCCGCCAGG
CACCGATCGCCAGGCCCACAACCAGCAGCGCACCGGCCTGACGCACGTGCAGCCAGGCCAACGCGGCATACCACAGCGGC
CACACCGGAAACGCCGGTGGCGGCTGCTGGGGCGCCGTCGCAGGAAATAGGGCCCACACTTTCGCCAGCCGGGGCAGCGC
CCCGGCGACCAGCAACGCGGCCAGGGCATGGCAGCCAGCATGACGTTTACGGCGATAAGTAGGTAGAAGCCGACCATCAT
GGCCAGTGTCACGGTGCGCGCGCACGTTTCGCCGAGTAGCACCGGCAGCGTTCGGATACCCAGCGGTTCGTCGTAACCGA
TCTTGTCGATGTGCTTACCCATCAGCACCGTGGTGCACAACAGCCCGTAGGGGAGCGACGCCAGCACGACCTCCCAACCG
CCCGCGCCCACCGCGGCGTAGTAGGTTCCAGCGCACGCTCGGGTGAGCCGCAGCTGGTGGTTCGTCGAGGCGTGGTATAT
GCGGCACGGTTGGCCCCGGTAGCGGCCGGGTGCTGGGCATAGCGGGCGCGCGCGTAGGTGGCGCTGTCAGTACCGACATC
GGTGTCGTAGAGATCGTTCATAAGGTTGTTGGCGATGTGCGGCGCATGTGATTCCCACCACAGGACGAGCCAGCGCCAAT
CCAAGCCAGGCTCGCCGATCGCCAACAGCCCCGCGACCAGGCCGGAGACCAGGGTCATCGGCAGCACTGCGGCCCGGGTG
ACGACGAGCCACCGGGTGACCGTGTCGGTCGGCCCGTCAGCTGGCGGGTTGGTGGTGCGAAGTGCGTAGGCCCACGATCT
```

FIGURE 7(continued)

```
GAGCCGGGAGCCCGCGCCCGCGTCGGGCATCCCTAAAGCCTAGACCTGCCCCCAGGCAGGCACGATCGGCGAAGGATGCG
GCTGCTCGCGAAACTTCTCCAACGATCCGCCGGCCTCGACGATGCCGCACAGTGCGCTCCAGCTCAGCATCGTCAGGTAG
TCGATCAGTTCGTCACTGCTCATGCGCGGGTCTGACATCCAGGAGTGGGTGGCCAGCTGCACGCCGCCCACGATCAGATA
TGCCCACGGCTCGACTCCGCCGGTGTCCATCCCGGCTTCTTGCATGCGGCGGCGCAGCATCACCGCGAGCATGCGGGCAA
TGATTCGCTCCGAGTCGGCAATCACTTTGCTTTTGCTGGCCGAGCTATTCGCCATCACGAACCGATACGGCTCCGGTTGG
GCCGCCACGGTCTCGACATAGACCCGGATGATTTCGCGGGTCAGTTCGAAACCATCCATATCGGCCGACAGCGCAGCGAT
CATGTTGGGGATCAAGGTGGTCTGCGTGAACCGCATCATCACGGCGGTCGTCAGGTCGTTTTTGTCGACGAAGTAGCGGT
AGAGCACGGTCTTGGAGACCCCGATCTCGGCCGCTATCTCGTCCATGCTGAGGAAGCGGCCATGCCGGCGAATCGCCTCA
ATCGTGCCGTCCACCAGCTCATTGCGGCGCTCCACCTTGTGCTGGTGCCAGCGTCGCTTGCGACCATCCGTCTTCACGGT
CACGGCCGGGATACGCTCTGCCACTGTTGCCAATTCCCATTCACTAGACGCTCCCGATACTACGGCCAATTGGGGGTCCT
GCTGGCACATTGGACGCGCGCGGGGTGCGCAGGACAGTGTCGTCACATTAACTGGTGCCGGTGATAGCGGATGATGGT
GTGGTGGCACATAAAGCCGAGGTGTCGGGCTCGCCGCCGCCACGGCTGAATTTGAGCACCCAGCCGACGGTGGCGCGGCG
TGTCCGCGCCTCCTTCGCGGAATCCTTCGCCGCAGCCGATCGGAGGCGGATGCCGCCCGGCGGATGGCGCTGCGTCGGA
TGAAAGTGGTGGCAGTGGGGTTTTTGGTAGGCGCCACCGGCGTGTTCCTCGCTTGTCGCTGGGCACAGGCCGATGGCGCT
GACCACGCGTGGCTGGGTTATCTGGGCGCTGCGGCGGAAGCCGGTATGGTCGGCGCCTTGGCGGACTGGTTCGCGGTGAC
CGCGCTGTTCAAGCATCCGCTAGGCATTCCGATCCCGCATACGGCGATCATCAAGCGCAAGAAGGATCAGCTGGGCGAGG
GCCTGGGCACCTTCGTGCGGGAGAATTTCCTGTCGCCGCCGGTCGTGGAGACCAAGCTGCGTGATGCGCAGATACCGAGT
CGGCTTGGCAAGTGGTTGTCAGAGGCCACGCATGCCCAGCGGGTGGCGGCCGAGACCGCAACGGTGCTGCGGGTGCTGGT
GGAGCTGCTGCGTGACGAGGACATCCAGCAGGTGATCGACCGGATGATTGTGCGTCGTATCGCCGAACCGCAGTGGGGTC
CGCCGGCGGGCCGGGTGCTGGCGACGTTGCTGGCCGAGAATCGGCAGGAAGCCTTTATCCAATTGTTGGCCGATCGGGCG
TTCCAGTGGTCGCTCAACGCCGGGGTGGTGATCCAGCGGGTGGTGGAGCGTGACTCGCCGAGTTGGTCGCCCCGATTCAT
CGACCACCTGGTTGGCGACCGTATCCACCGTGAGTTGATGGAATTTACCGACAAGGTGCGCCGCAACCCCGATCACGAGT
TGCGCCGTTCGGCTACCCGCTTCTTGTTCGATTTCGCTGACGACCTGCAACACGATCCGGCCACTGTCGCGCGCGCCGAC
GCGATCAAGAGGAGCTAATGGCGCGCGATGAGATCGCCACTGCGGCCGCGGCGGCGTGGAAGACACTGAAGCGGTTGGT
GCTCGAGGGTGTTGACGACCCGTCCAGTGCGTTGCGCACCCGCATCACCGATGCGGTCATCCGGATCGGCGAATCGCTTC
GTGACGATGCCGACCTGCGTGACAAGGTAGACAGTTGGACGGTGCGGGCGGCCCAACATCTGGTCTCGGAGTACGGGGTG
GAGATCACCGCGATCATCACCGAGACGATCGAGCGCTGGGACGCCGAGGAAGCCAGCCGGCGAATCGAACTGCACGTCGG
CCGAGACCTGCAGTTCATTCGGATCAACGGAACAGTGGTCGGGGCGGATGGCAGGGTTGGCGATCTATGCGATCGCGCAAC
TGTTGTTCTGACGGGTGCTAACAAACGCTTGCAATAGCAAGCACTTGGACGTACTCTGGTGGCCGTTGCACCGATCACCC
CGAGCTAGGAGTAGCCAATGTCGTCGGAGGAGAAGCTGGCCGCCAAGGTGTCCACCAAGGCCTCCGATGTGGCTTCCGAC
ATCGGCAGCTTCATCAGGTCGCAACGTGAGACGGCGCACGTCTCGATGCGGCAGCTCGCCGAGCGGTCCGGCGTCAGCAA
TCCGTACCTGAGCCAGGTTGAGCGCGGATTGCGTAAGCCGTCCGCCGACGTGTTGAGCCAGATCGCAAAGGCGCTGCGGG
TCTCGGCCGAAGTCCTTTATGTGCGCGCCGGGATTCTCGAGCCCAGCGAGACCAGTCAGGTGCGTGACGCCATCATCACC
GATACGGCCGATCACCGAGCGTCAGAAGCAGATTCTGCTCGATATCTACGCGTCATTTACCCACCAGAACGAAGCCACCCG
GGAGGAGTGTCCGAGCGATCCGACACCGACCGATGACTAGCCGTTGGCCGGCTGTTTTGCGCACCGGCTGGCGGGTAATC
AAAACCTCAAGGACAGTCATCTGGGTGAGGTCGACCGCAGGCTGATCCAGCCGATCGGCCGCGCTGGCCAACAGCGACTCC
GTCGATGACGTGCAGCAAAGGAGACATGTAGTGACCGGATCAGCTGGGCCTGACATCTACGAACTCGACCGACAACCGAC
CCGACGATCAGAAGGTTTCCCCGGCAAGTCGCGTGCCATGTCAATCCGCGGGTCTTGACTAGTCCTCCCTGGAGGAGCCG
ACGCTTGCCCCAACGTCCAGACCAAAGATGTAAGAACGCCGATATCAGAAAATAGTTAATGAAAGGAATACCCATGGCTG
AAAACTCGAACATTGATGACATCAAGGCTCCGTTGCTTGCCGCGCTTGGAGCGGCCGACCTGGCCTTGGCCACTGTCAAC
GAGTTGATCACGAACCTGCGTGAGCGTGCGGAGGAGACTCGTACGGACACCCGCAGCCGGGTCGAGGAGAGCCGTGCTCG
CCTGACCAAGCTGCAGGAAGATCTGCCCGAGCAGCTCACCGAGCTGCGTGAGAAGTTCACCGCCGAGGAGCTGCGTAAGG
CCGCCGAGGGCTACCTCGAGGCCGCGACTAGCCGGTACAACGAGCTGGTCGAGCGCGGTGAGGCCGCTCTAGAGCGGCTG
CGCAGCCAGCAGAGCTTCGAGGAAGTGTCGGCGCGCGCCGAAGGCTACGTGGACCAGGCGGTGGAGTTGACCCAGGAGGC
GTTGGGTACGGTCGCATCGCAGACCCGCGCGGTCGGTGAGCGTGCCGCCAAGCTGGTCGGCATCGAGCTGCCTAAGAAGG
CTGCTCCGGCCAAGAAGGCCGCTCCGGCCAAGAAGGCCGCTCCGGCCAAGAAGGCGGCGGCCAAGAAGGCGCCCGCGAAG
AAGGCGGCGGCCAAGAAGGTCACCCAGAAGTAGTCGGGCTCCGAATCACCATCGACTCCGAGTCGCCCACGGGCGACTC
GGAGTCGACGTGTTGGATGCAAACCGCATAGTCTGAATGCGTGAGCCACCTCGTGGGTACCGTCATGCTGGTATTGCTGG
TCGCCGTCTTGGTGACAGCGGTGTACGCGTTTGTGCATGCTGCGTTGCAGCGGCCCGATGCCTATACCGCCGCCGACAAG
CTGACCAAGCCGGTGTGGTTGGTGATCCTGGGCGCGGCCGTGGCGTTGGCCTCCATCCTGTATCCCGTTTTGGGTGTGCT
CGGGATGGCGATGTCCGCCTGTGCGTCCGGCGTGTATCTGGTCGACGTGCGGCCCAAGCTTCTCGAGATTCAGGGCAAGT
CGCGCTAACGGAATGAAAGCCCTGGTGGCCGTGTCGGCGGTGGCCGTCGTCGCACTGCTCGGTGTATCTTCCGCCCAAGC
TGATCCCGAGGCGGATCCCGGCGCAGGTGAGGCCAACTATGGTGGCCCCCAAGTTCCCCACGTCTTGTCGATCACACCG
AATGGGCGCAGTGGGGAAGTCTGCCCAGCCTCCGGGTCTACCCGTCCCAAGTTGGGCGTACAGCCTCCCGCCGCCTCGGG
ATGGCCGCTGCCGACGCGGCCTGGGCCGAGGTTCTCGCGCTGTCACCGGAGGCCGACACTGCCGGCATGCGCGCGCAGTT
CATCTGCCACTGGCAGTACGCCGAAATCAGACAACCCGGCAAACCCAGCTGGAACCTCGAGCCGTGGCGGCCGGTCGTCG
```

FIGURE 7(continued)

```
ACGACTCGGAGATGTTGGCTTCCGGCTGCAATCCGGGCAGCCCTGAAGAGTCGTTTTAGTGCTCGGCCAACCGACTCGGG
CGCAGTTGGCCGCGCTGGTAGACCACACCCTGCTCAAGCCTGAGACCACCCGTGCCGATGTGGCCGCGCTGGTCGCCGAA
GCCGCCGAACTCGGCGTCTACGCGGTCTGCGTGTCGCCGTCGATGGTGCCAGTTGCGGTCCAAGCCGGTGGTGTGCGGGT
TGCGGCGGTGACGGGCTTCCCGTCGGGCAAGCACGTGTCCTCGGTCAAGGCGCATGAGGCGGCTGCGGCCCTGGCATCCG
GCGCCAGTGAGATCGACATGGTCATCGACATCGGGGCTGCGCTGTGCGGTGACATCGACGCAGTGCGTCCGACATCGAG
GCGGTGCGTGCCGCTGCGGCCGGGGCTGTGCTCAAGGTGATCGTGGAGTCGGCGGTGCTGTTGGGACAGTCAAACGCGCA
CACGTTGGTGGATGCGTGTCGTGCCGCCGAGGATGCCGGTGCCGACTTCGTCAAAACCTCGACTGGGTGTCATCCGGCCG
GCGGGGCACGGTGCGTGCCGTCGAGCTGATGGCCGAGACGGTCGGCCCTCGGCTAGGGGTCAAAGCCAGCGGTGGGATC
CGCACCGCCGCCGACGCGGTCGCGATGCTCAACGCCGGTGCCACCAGGTTGGGCCTGTCCGGCACCCGGGCGGTGCTCGA
TGGGCTCAGCTGACAGCTGAGCGCGCGGGTGGCGGCGTCAAATGTGCGAGAAGCAGGGATTCTGGATGCCGGTGGGGATA
GCCGCGTCGCGAGTTGAGAACCGGCTCACCACGCCGGTCGAGGTGACTTGCACGCTGTCCGCGTGAATCCCCAACGGGTA
GTTCTTGGTCAGGCTGGAGGTGAACTCGTTCAGCGTCGACTGAACGGTTTCTTTCGGCAGCGAGAACCCGAGCGTGTTGA
AATTGATGATCTGCAGCTCCAATCCTTTGCCAGCCACTATCGGCTTGGCTGTGATGTTGTTCAGCAGGCCCTTCAGTTCG
ACGGTGCCGTCTGCGGGGTGAGTGACCACGCTGCTGGTGACGAAAGCGCCCAGGATCGGAATCGCGTTTTGCACCGATTC
CTTGATGCCTTCCGACGACCAGGTAATGGTGGCGTCCAGGGCGCCGATCGTGCCCCTAGAGTTGGGGGTGTTCTTGAGCC
GGACGTTCTGGATCGTGAGCTTTATCTGCATGCCCTTGGCATCGCGGATCTGATTGCCCGCGGTTTCCACCGAGATATTG
GTGAAGTGCCGCGTAGCGACCTGCCACAGCAGCAGCGGCGCCACACCGAAGGATGCGGTGGCTTGGTCTTTGACCACGCA
TGCGACCGCTTGGGCGACCTTGCTATTGGCAACATGGCGAGCGTATAGCTCGCCTCCGATCAGCCCGGCGAGGACGAGCG
AAAACACGATGATCAGGACAAGAAAGACGGTTAGCGGGTCGCGGCGGGCACGTCGTTTGGTCTTCACCGCCGCTGGCTCT
TCCTCTTGCGCAGCCAGCAGGCCCGTTGGGTCCCACGCCTGGTGCGCAGCCTTGGCGGCCGGATCGCCGTGTGTGGGCATG
CGACGCAGCCAGATGCTCAGTTTGCGGCTGCTGCTCCGGTTGGGTGGGCGGACTCACCGGTTCTTGGATATGACCCGCGG
GCTCGCCGGGGCGCAGTCGACCGGTGGATGCTTCGGACGATGCCGGGGGTCGGCGAGCGGACCTTGATCCCCAGGGCGC
GCCCAGGGCGACGGGTCGTTCGGTGGACCTTGCGGGTTGGTCACCCACGCGATTGTGCCTTATCGATCTGAACGAAGTCT
GTCTGGTTGCGTAGCACCGCAATGCGGTCGCGAGCCGCGGCCACATTGTCGACATCGATGTCGGCGACCAGCAGTTGCGG
CTGGGTGCCAGCTGACACCACCACCTCGCCTAGCGGCGAGGCCACCAGGCTGCCGCCTACCCCGGTCGGTGCAGCCGAGC
TCGCCCCCACGCCGGTGCGGGCATCACCTGGGTCTGCTTGGCCGGCCGCGGCGACGTAACTCATGGAGTCTAGCGCCCGG
GCGCGGGCCAGCAACGTCCACTGTTCGAGTTTGCCCGGACCGGAACCCCAGGATGCACAGACCGCGATCAGTTGGGCCCC
GCGCCGCCGCAGCTCGGTATAAAGGGCGGGAAAGCGAATGTCGTAGCAAACGGTCAAACCCACCCGCACGCCGTCGACCA
CGACTACCACCGGTTCGCGCCCGGGTGCGACGGTACGTGACTCGGTGAAGCCGAACGCGTCATAGAGGTGGATCTTGTGG
TAGTGCGCGTCCGGCTGATTGGGCGTGCCCGGGCCGGCTGCGATCAGCGTGTTTGTTACCCGCCCGTCGCCGGTCGGGGT
GAACATGCCGGCGATCACGGTGATGCCCGCCTCGGTCGCGATCCGTCGGACTCCGTTTGCCCAGGGTCCGTCGACGGGCT
CGGCGACCTGCCGCAGCGGGACACCGAGCCGGCACATGGTCGCCTCAGGAAACACCACCAGCTGTGCGCCCGCGGTGGCG
GCTTCGCCGGCGTACTTGCCGACCAGTTGCAGATTGGCGGCGGGGTCGGTACCGCTGCGGATTTGCGCCAACGCGATTCG
CATGCGCGCCAGCCTAGGCCCGGCGACGAGCGCGCCGCACCGGCGCGCGCAGGAGCCGGGCAATCCAGCTTGCGCCCGGC
GACGAGCGCGCCGCACCGGCGCGCGACGAGGAGCCGGGCAATCCAGCTTGCGCCCGGCGACGAGCGCGCCGTACCGCGCG
GCAGGAGCCGGGCAAGCTGGCACCTCAGACGTTGTTCGTGATCCACAGCGTGGTGAAGCGCTGTTCGATGGTCACTAGCT
GGCTTAATTGGGTGCCGATAAGCCTCTCCAGCTTCCCGCCAATGAACGGGATACGCACCTGGATGGTGACCTGCAGCGTC
ATTCGGGAGCCACCCGACTCCGGTATGGGCGAGAGCACGGCGGTGCCCCACAAGTTCACCGGAGCGTCCACGATCGATCC
CGCAATGGACGCGGTCGCGATGCCTTCCTTGACCGGGCCCCAGGTCTCCTCGCGCCGTACCGAAAGATCGCCCCGGTGCA
ACTGTGTGACCAGGCCGGGCAGATTGTGACTGCGCACCATCTGCAGGGTGACGACTTCGATGGTGCCGTCGTCTCCGGAG
TCGCCACCTACGCGTATCGACTCAAGGGTCGCGACGTCGACCGGCGTTTCGGCCAGTCTGGCTTTCAGTAGTCCGCCTC
GTAGAAAGCCCGATGAACCTCCTCGACGCTGCCCTCGTAGTCGGCCGACATGTCGAATGAACGCGGCATAGCAGGTCAGG
CTACCCTTACGGGCCATGAAACGGAGCGGTGTCGGTTCGCTCTTTGCCGGTGCGCATATTGCCGAGGCGGTCCCGTTGGC
GCCGCTGACCACTTTGCGTGTGGGCCCGATCGCCCGACGTGTCATCACTTGCACCAGCGCCGAACAGGTGGTGGCTGCGC
TGCGGCACCTGGATTCGGCGGCCAAGACCGGAGCTGACCGCCCGCTGGTGTTTGCTGGTGCTCCAATTTGGTGATCGCC
GAGAACCTGACCGACCTGACCGTGGTGCGGTTGGCCAATAGCGGCATCACCATCGACGGTAACTTGGTGCGGGCCGAGGC
CGGTGCGGTCTTCGATGACGTGGTGGTTAGGGCCATCGAACAGGGTCTGGGCGGACTGGAATGCCTGTCTGGCATCCCAG
GATCGGCCGGGGCGACACCCGTGCAGAACGTGGGGGCGTATGGCGCGGAGGTGTCTGACACCATCACTCGGGTTCGGCTT
TTGGATCGGTGCACGGGTGAGGTGCGTTGGGTATCCGCGCGCGACCTGCGCTTCGGCTATCGCACGAGCGTGCTCAAACA
CGCTGATGGGCTTGCGGTGCCCACCGTGGTCTTGGAGGTGGAGTTTGCGCTGGATCCGTCGGGCCGCAGCGCACCGCTGC
GCTACGGCGAGCTGATCGCCGCGCTGAATGCGACCAGCGGCGAGCGCGCCGACCCGCAAGCGGTCCGCGAAGCGGTGCTG
GCCCTGCGGGCACGCAAGGGCATGGTGCTGGACCCGACCGACCATGACACCTGGAGCGTGGGATCGTTCTTCACAAACCC
GGTGGTCACCCAGGATGTTTACGAACGGCTGGCCGGTGACGCGGCCACCAGAAAGGACGGTCCGGTCCCGCACTATCCCG
CGCCCGACGGCGTCAAGCTGGCCGCCGGCTGGCTGGTGGAACGGGCCGGCTTCGGCAAGGGCTATCCGGATGCCGGCGCC
GCCCCATGCCGGCTTTCCACCAAACATGCGCTGGCGCTGACAAATCGTGGCGGGGCCACCGCCGAAGATGTGGTGACGCT
GGCGCGCGCCGTGCGCGATGGGGTCCATGATGTGTTTGGTATCACACTAAAACCCGAACCCGTGCTGATCGGCTGCATGT
```

FIGURE 7(continued)

```
TGTAGCTGCGTTTTCGCGGCGGGGCGGCGTGGCGCGCATTGCTTAGGGCTGGTTGCCAGGCGTTCTGTGGTCATTCGTGT
GCTGTTTCGCCCGGTATCTTTGATACCCGTGAATAACTCCAGCACCCCCCAGAGTCAGGGGCCGATCAGTCGGCGTCTGG
CGTTGACGGCCCTTGGGTTTGGGGTGTTGGCACCGAACGTTCTGGTCGCGTGCGCCGGCAAAGTGACCAAGCTGGCCGAG
AAGAGGCCGCCACCGGCGCCTCGTCTGACTTTCCGGCCTGCCGACTCTGCCGCCGACGTGGTGCCGATCGCGCCGATCAG
CGTCGAGGTCGGTGACGGCTGGTTTCAGCGGGTCGCGCTGACCAATTCGGCAGGCAAGGTCGTCGCCGGGGCATACAGCC
GGGATCGCACCATCTACACGATCACCGAGCCGCTGGGCTACGACACGACCTACACCTGGAGCGGTTCGGCCGTCGGCCAT
GACGGCAAGGCGGTTCCGGTGGCGGGCAAGTTCACCACCGTGGCACCCGTCAAGACGATCAACGCGGGATTCCAGCTCGC
CGACGGCCAGACCGTCGGGATCGCGGCGCCGGTGATTATTCAGTTCGATTCACCGATCAGCGACAAGGCCGCCGTCGAGC
GGGCACTAACCGTGACCACCGACCCGCCTGTCGAGGGCGGCTGGGCCTGGCTGCCCGACGAGGCGCAGGGCGCTCGCGTG
CACTGGCGTCCTCGGGAGTACTACCCGGCGGGTACCACCGTCGACGTCGACGCCAAGCTGTATGGGCTGCCGTTCGGCGA
CGGCGCGTACGGCGCGCAGGATATGTCGTTGCACTTCCAGATCGGTCGTCGTCAGGTGGTCAAGGCCGAAGTCTCGTCGC
ACCGCATCCAAGTCGTCACCGATGCCGGCGTCATCATGGACTTCCCGTGCAGCTACGGCGAGGCCGACTTGGCGCGCAAC
GTCACCCGCAACGGCATCCACGTCGTCACCGAGAAATACTCGGACTTCTACATGTCCAACCCGGCCGCCGGTTACAGCCA
TATCCACGAACGTTGGGCGGTGCGGATTTCCAACAACGGCGAGTTCATCCATGCCAACCCTATGAGCGCCGGTGCCCAGG
GCAACAGCAATGTCACCAACGGCTGTATCAACCTGTCGACGGAGAACGCCGAACAGTACTACCGCAGCGCGGTCTACGGT
GACCCGGTTGAGGTGACCGGCAGTTCGATCCAGCTGTCCTACGCCGACGGTGACATCTGGGACTGGGCGGTGGACTGGGA
CACCTGGGTGTCGATGTCGGCGCTACCGCCACCGGCGGCCAAACCGGCGGCGACGCAAATCCCGGTCACCGCCCCGGTCA
CGCCGTCGGATGCCCCCACCCCGTCCGGCACACCCACGACTACTAACGGACCGGGTGGGTAGCGCGACGGCTAGCTGATG
CCTGGTCGCGGGGCCGGATGACGATCTGGTCAAGGTTGACGTGTGAGGGCCGGGTGGCCACGAATCCGATCACCTCGGCG
ACGTCGGCGGCTACTAGCGGTGTCATGCCGGCATAAACCGCGTCCGCGCGTTGCTGGTCGCCGTCGAAGCGGACCAGCGA
AAATTCGGTCTCGACCGCCACCTGGACGCGATCTCGGTGAGCCCGGACCGGCTTCCCCAGCAGTTCGCCGCGCAGCGTGCAT
GCAGCGCGCCCTGCGCGTGCTTGGCAGCGGTGTAGCCGGCGCCGCCGTCGTCACACCTCGATCGGCGGCGATCGAGGTGACG
GTGACGATCAGGCCGTCGCCGGAGTCGATCAGCTTGGGCAGCAGCGCGCGGGTTACCCGCAGCGTGCCCAGTACGTTGGT
GTCCCACATCCATCGCCAGTGCTCCAAATCGGCATCGGCGACGAACTGAAGCCCCTTGGCGCCACCGGCGTTGTTGACCA
GCACGTCCACCCGGCTCAGCGCGCGGGCCAACGCTTCGACGGCGGCGTCGTCAGTGACATCGGCCACAATTGCGGTTCCG
CCGATCTGGTTGGCCAGCGCGGTGATCCGGTCCGCCCGACGCGCCACCGCGACCACGTGAAACCCCTGGGCCGCAAGGGT
TCTCGCGGTTGCCTCGCCGATACCGGAACTGGCGCCGGTGACCACGGCGACTCGCTTGCGGGTGCCGATTGTCGTCATCG
GGACAACTCTAATAAACGTGCTAAATTCTCGGTGTGTACCACAGCGCCTTGTTCGCACGACGACCGCGTGTCTTTTCGC
GGGCGCGTGTTGTTGCCGCCCCCTTTGCCGCGCCTGACCGATACACGTCAGCAGGTGTGGCCAACAGGACCCGGCCATTG
GAACTCGGAGAAGAACGCCCGTGTACTCGACTAACCGCACCTCACAGTCACTCAGCCGCAAGCCCGGCCGCAAGCACCAG
CTGCGATCGCACCGTTACGTCATGCCGCCGTCGCTGCACCTGTCCGATTCCGCGGCTGCGTCCGTCTTCCGGGCCGTGCG
TTTGCGTGGTCCGGTCGGTCGGGACGTAATTGCTGGATCTACGTCGCTGAGCATCGCGACGGTGAACCGCCAGGTCATCG
CACTGCTGGAAGCGGGCCTCCTGCGTGAGCGGGCGGACCTGGCGGTTTCCGGGGCTATCGGGCGCCCACGCGTGCCTGTC
GAAGTAAACCACGAGCCTTTTGTCACCCTGGGCATCCACATCGGTGCCCGGACCACCAGCATCGTGGCCACCGACCTGTT
CGGCCGCACGCTCGACACGGTGGAGACCCCGACCCCGCGTAACGCTGCCGGGGCCGCGCTGACCTCACTGGCCGACAGCG
CTGACCGATACTTGCAGCGCTGGCGCCGGCGCCGTGCGCTGTGGGTCGGGGTGACGCTTGGTGGTGCAGTCGACAGTGCC
ACCGGTCATGTCGACCATCCGCGGCTCGGTTGGCGTCAGGCTCCGGTCGGACCCGTGCTGGCGGATGCCCTAGGCCTGCC
CGTGTCGGTGGCGTCCCACGTCGACGCCATGGCCGGGGCCGAGCTGATGCTCGGCATGCGGCGGTTCGCACCGAGCTCGT
CGACGAGCCTCTACGTCTACGCCCGCGAAACCGTAGGCTATGCGCTGATGATCGGTGGGCGGGTGCACTGCCCGGCCAGT
GGTCCCGGCACCATCGCGCCCTGCCCGTCCACTCTGAAATGCTCGGCGGTACCGGGCAGCTGGAGTCCACTGTCAGCGA
CGAGGCGGTTTTGGCTGCTGCCCGCCGGCTGCGGATCATCCCCGGCATCGCTTCGAGGACCCGGACCGGTGGGTCCGCTA
CCGCCATCACCGACTTGCTGCGAGTGGCACGAGCCGGTAATCAGCAAGCCAAGGAGCTGCTGGCGGAGCGGGCCCGCGTG
CTCGGTGGGGCGGTCGCGCTGCTGCGTGACTTACTCAATCCCGACGAAGTGGTGGTGGGTGGCCAGGCGTTTACCGAATA
TCCCGAGGCGATGGAGCAGGTGGAGGCGGCGTTTACGGCAGGGTCGGTGCTGGCGCCGCGTGACATCCGCGTGACCGTTT
TCGGCAACCGGGTGCAGGAGGCCGGGGCAGGCATCGTGTCCCTAAGCGGGCTCTATGCCGATCCATTGGGTGCCTTGCGG
CGATCGGGCGCGCTGGATGCCCGGCTGCAGGACACCGCCCCGGAGGCGCTCGCGTGATCGGCTGACGAGCCGCGTCCGCG
CGTGTCACTTCGGTTCCTGCAAGGATGGCAGGTGTGCGGCACGATGACGGTTCAGGGTTGATCGCCCAGCGCCGTCCGGT
CCGCGGCGAGGGTGCCACCCGCTCGCGCGGCCCATCCGGGCCATCCAATCGGAATGTTTCGGCAGCAGACGACCCGCGCC
GGGTTGCGCTGCTGGCGGTGCACACCTCACCGCTGGCACAGCCGGGCACCGGTGACGCCGGCGGCATGAACGTCTACATG
CTGCAAAGTGCGCTGCACCTGGCCCGTCGGGCATCGAGGTGGAGATCTTCACCCGGGCCACCGCATCGGCAGATCCACC
GGTGGTGCGGGTGGCACCCGGGGTGCTGGTGCGCAACGTGGTGGCGGGGCCCTTCGAGGGTTTGGACAAGTACGACCTGC
CCACCCAGCTTTGTGCGTTCGCCGCCGGGGTGCTGCGCGCCGAGGCGGTCCACGAACCGGGTTACTACGACATCGTGCAC
TCGCACTACTGGCTGTCGGGTCAGGTCGGCTGGCTGGCGCGACCGCTGGGCGGTTGCCGTTGGTGCACACCGCACACAC
GCTGGCCGCCGTGAAGAACGCGGCACTGGCCGACGGCGACGACCCGAGCCGCCGCTGCGTACGGTCGGGGAGCAGCAGG
TCGTCGACGAGGCGGATCGGTTGATCGTCAACACCGACGATGAAGCCAGGCAAGTGATTTCGCTTCATGGTGCCGATCCG
GCACGAATCGACGTGGTCCATCCCGGTGTCGATCTGGACGTGTTCCGCCCGGGTGATCGGCGCGCGGCCCGGGCCGCGCT
```

FIGURE 7(continued)

```
AGGACTACCAGTTGACGAGCGCGTGGTGGCCTTCGTCGGACGCATCCAGCCGCTGAAGGCACCCGACATTGTGCTGCGTG
CGGCCGCCAAGTTGCCCGGGGTGCGCATCATCGTGGCCGGCGGACCGTCGGGCAGCGGTCTGGCTTCACCGGACGGACTG
GTCCGGCTCGCCGACGAACTGGGCATCTCTGCACGGGTGACGTTTCTGCCGCCGCAGTCCCACACGGATCTGGCCACCTT
GTTTCGGGCGGCGGACCTGGTTGCGGTGCCGAGCTACTCCGAGTCGTTCGGCCTGGTTGCTGTGGAGGCCCAAGCGTGCG
GCACACCGGTGGTGGCCGCGGCGGTGGGCGGGCTGCCCGTCGCGGTGCGCGACGGGATCACCGGCACCCTGGTGTCCGGG
CACGAGGTCGGTCAGTGGGCCGACGCCATCGATCACCTGCTGCGGTTGTGTGCCGGGCCACGGGACGGGTGATGAGCCG
GGCGGCGGCACGGCACGCCGCCACGTTCTCGTGGGAGAACACCACCGACGCGCTGTTGGCCAGTTATCGGCGTGCGATCG
GCGAGTACAACGCCGAGCGCCAGCGCCGGGGCGGCGAGGTGATATCGGACCTGGTAGCGGTGGGCAAGCCCCGCCACTGG
ACGCCGCGTCGCGGGGTGGGCGCGTGACTTCCTCCTTGCCGACCGTGCAACGTGTGATCCAGAATGCGCTCGAGGTCAGC
CAGCTGAAGTACTCCCAACACCCCCGCCCGGGCGGGGCGCCGCCGCGCTGATCGTCGAGCTGCCGGGCGAACGCAAGCT
CAAGATCAACACCATCCTGAGCGTCGGCGAGCATTCGGTGCGTGTCGAGGCGTTCGTGTGTCGCAAGCCTGACGAGAACC
GCGAAGACGTATACCGGTTCCTGCTGCGGCGCAACCGCCGCCTGTATGGGGTCGCGTACACGCTGGACAATGTCGGCGAC
ATCTACCTGGTGGGCCAGATGGCGCTGTCCGCAGTGGACGCCGACGAGGTTGACCGGGTGTTGGGGCAGGTGTTAGAGGT
GGTGGATTCGGACTTCAATGCGTTGTTGGAGTTGGGATTTCGGTCGTCGATTCAACGAGAGTGGCAGTGGCGGTTATCTC
GCGGTGAGTCGCTGCAGAACCTGCAGGCCTTCGCTCACTTACGCCCGACGACGATGCAGAGCGCGCAGCGCGATGAGAAG
GAGTTGGGCGGTTAGGTCGAGCCCGACGACGATGCAGAGCGCGCAGCGCGATGAGAAGGAGTTGGGCGGTTAGGTCGAGC
CCGACGACGATGCAGAGCGCGCAGCGCGATGAGAAGGAGTTGGGCGGTTAGGTCGAGCCCGACGACGATGCAGAGCGCGC
AGCGCGATGAGAAATAGCACTCGTGGAGGTCAAGACGCCCGCCGGTGATGGGCTGGTGGCGCTCACCCCGTTCCGGACTC
AGAAATTCGCGATCACAATTTGCGCGTTCAAGTCATTGGCATGCATGTGATGGTTTAGCGTTCCGCTGTGCCTCTTCAGG
TGTTTGTCGGCTTCGTTGCCATGATGACGCTCAAGGTCGCGATCGGCCCGCAAAACGCATTTGTCCTGCGCCAAGGAATT
AGGCGAGAATACGTGCTGGTCATTGTGGCGCTGTGCGGGATCGCTGATGGGGCACTGATTGCCGCGGGCGTTGGCGGCTT
CGCTGCGCTGATTCACGCTCATCCCAATATGACTTTGGTTGCCCGATTTGGCGGCGCAGCGTTCTTGATTGGCTACGCGC
TATTGGCCGCGCGGAACGCGTGGCGCCCGAGCGGGCTGGTGCCGCTCGGAATCGGGGGCCGGCTGCGCGTGATCGGCGTGGTG
CAAATGTGCCTGGTGGTGACCTTTCTCAACCCACACGTCTATCTGGACACTGTGGTGTTGATCGGTGCCCTCGCCAATGA
GGAATCAGATCTGCGGTGGTTTTTCGGAGCCGGTGCCTGGGCCGCCAGCGTCGTATGGTTCGCCGTGTTGGGATTTAGCG
CGGGCCGGCTACAGCCATTCTTCGCAACTCCAGCTGCTTGGCGCATTCTTGATGCGCTGGTTGCCGTGACGATGATTGGG
GTCGCCGTCGTTGTGCTCGTCACGTCACCAAGTGTGCCGACGGCCAATGTCGCACTGATCATTTGACCACCTCGTAGGCC
GCCCATGTATCGGCCTTGGTGAACCGGCCGTTACGGTGCCGACCACCTCGGCGGTATGAACGCGCTGCGCAGCGGACCGA
GGAGAATTCGGGCATTTTGGTCCACGATGAGGAGTGCGGGAGTGCGTGAAGACTTGCCGGTATGGCAAACACTGGCAGC
CTGGTGTTGCTGCGCCACGGCGAGAGCGACTGGAATGCCCTCAACCTGTTCACCGGCTGGGTCGATGTCGGCCTGACGGA
CAAGGGCCAGGCAGAGGCGGTTCGAAGCGGCGAGCTGATCGCGGAACACGACCTATTGCCCGACGTGCTCTACACCTCGT
TGCTGCGGCGCGCGATCACCACCGCGCATCTGGCGTTGGACAGCGCCGATCGGCTCTGGATTCCCGTGCGGCGTAGCTGG
CGGCTCAACGAACGCCACTACGGCGCGCTGCAGGGTTTGGACAAGGCCGAGACCAAGGCCCGCTATGGCGAAGAGCAGTT
CATGGCCTGGCGGCGCAGCTATGACACGCCGCCGCCGCCGATCGAGCGGGGCAGTCAGTTCAGCCAGGACGCCGACCCTC
GTTACGCCGACATCGGCGGTGGCCCGCTCACCGAATGTCTGGCTGACGTGGTCGCCCGGTTTTTGCCATATTTCACCGAC
GTCATCGTTGGCGACTTGCGGGTCGGCAAGACGGTGCTGATCGTTGCCCACGGCAACTCGTTGCGCGCGCTGGTCAAGCA
CCTGGACCAGATGTCTGACGACGAAATCGTCGGACTGAACATCCCGACCGGAATTCCGCTGCGCTACGACCTGGATTCCG
CGATGAGGCCGCTGGTGCGCGGTGGTACGTATCTGGACCCGGAGGCGGCAGCCGCCGGCGCCGCCGCGGTGGCCGGCCAG
GGCCGCGGGTAATTGTTTGAGATCCCACCTGCCGGCGGTTTCGGCGGCTGATGGTGTGCTTTGGTGCGCTGTTTGCCAAA
CAGCATGTGAACGGTAACCGAACAGCTGTGGCGTAGTGTGTGACTTGTCCGATTTTGGCCTTGCCGCGCTAGGGCGACGT
TCACCGGATTTGTAGGATTTTCCTTGTGACTGTGTTCTCGGCGCTGTTGCTGGCCGGGGTTTTGTCCGCGCTGGCACTGG
CCGTCGGTGGTGCTGTTGGAATGCGGCTGACGTCGCGGGTCGTCGAACAGCGCCAACGGGTGGCCACGGAGTGGTCGGGA
ATCACGGTTTCGCAGATGTTGCAATGCATTGTCACGCTGATGCCGCTGGGCGCCGCGGTGGTGGACACCCATCGCGACGT
TGTCTACCTCAACGAACGGGCCAAAGAGCTAGGTCTGGTGCCGACCGCCAGCTCGATGATCAGGCCTGGCGGGCCGCCC
GGCAGGCGCTGGGTGGTGAAGACGTCGAGTTCGACCTGTCGCCGCGCAAGCGGTCGGCCACGGGTCGATCCGGGCTATCA
GTGCATGGGCATGCCCGGTTGCTGAGCGAGGAAGACCGCCGGTTCGCCGTGGTGTTCGTGCACGACCAGTCGGATTATGC
GCGGATGGAGGCGGCTAGGCGTGACTTCGTGGCCAACGTCAGTCACGAGCTCAAGACGCCCGTCGGTGCCATGGCTCTAC
TCGCCGAGGCGCTGCTGGCGTCGGCCGACGACTCCGAAACCGTTCGGCGGTTCGCCGAGAAGGTGCTCATTGAGGCCAAC
CGGCTCGGTGACATGGTCGCCGAGTTGATCGAGCTATCCCGGCTACAGGGCGCCGAGCGGCTACCCAATATGACCGACGT
CGACGTCGATACGATTGTGTCGGAAGCGATTTCACGCCATAAGGTGGCGGCCGACAACGCCGACATCGAAGTCCGCACCG
ACGCGCCCAGCAATCTGCGGGTGCTGGGCGACCAAACTCTGCTGGTTACCGCACTGGCAAACCTGGTTTCCAATGCGATT
GCCTATTCGCCGCGCGGGTCGCTGGTGTCGATCAGCCGTCGCCGTCGCGGTGCCAACATCGAGATCGCCGTCACCGACCG
GGGCATCGGCATCGCGCCGGAAGACCAGGAGCGGGTCTTCGAACGGTTCTTCCGGGGGGACAAGGCGCGCTCGCGTGCCA
CCGGAGGCAGCGGACTCGGGTTGGCCATCGTCAAACACGTCGCGGCTAATCACGACGGCACCATCCGCGTGTGGAGCAAA
CCGGGAACCGGGTCAACGTTCACCTTGGCTCTTCCGGCGTTGATCGAGGCCTATCACGACGACGAGCGACCCGAGCAGGC
GCGAGAGCCCGAACTGCGGTCAAACAGGTCACAACGAGAGGAAGAGCTGAGCCGATGACCTGCGCCGACGACGATGCAGA
```

FIGURE 7(continued)

```
GCGTAGCGATGAGGTGGGGGCACCACCCGCTTGCGGGGGAGAGTGGCGCTGATGACCTGCGCCGACGACGATGCAGAGCG
TAGCGATGAGGTGGGGGCACCACCCGCTTGCGGGGGAGAGTGGCGCTGATGACCTGCGCCGACGACGATGCAGAGCGTAG
CGATGAGGTGGGGGCACCACCCGCTTGCGGGGGAGAGTGGCGCTGATGACCAGTGTGTTGATTGTGGAGGACGAGGAGTC
GCTGGCCGATCCGCTGGCGTTTCTGCTGCGCAAGGAGGGCTTTGAGGCCACGGTGGTGACCGATGGTCCGGCAGCTCTCG
CCGAGTTCGACCGGGCCGGCGCCGACATCGTCCTGCTCGATCTGATGCTGCCTGGGATGTCGGGTACCGATGTATGCAAG
CAGTTGCGCGCTCGGTCCAGCGTTCCGGTGATCATGGTGACCGCCCGGGATAGCGAGATCGACAAGGTGGTCGGCCTGGA
GCTGGGCGCTGACGACTACGTGACCAAGCCCTATTCGGCACGCGAGTTGATCGCACGCATCCGCGCGGTGCTGCGCCGTG
GCGGCGACGACGACTCGGAGATGAGCGATGGCGTGCTGGAGTCCGGGCCGGTTCGCATGGATGTGGAGCGCCATGTCGTC
TCGGTGAACGGTGACACCATCACGCTGCCGCTCAAGGAGTTCGACCTGCTGGAATACCTGATGCGCAACAGCGGGCGGGT
GTTGACTCGCGGACAACTGATCGACCGGGTCTGGGGTGCGGACTACGTGGGCGACACCAAGACGCTCGACGTCCATGTCA
AGCGGCTGCGCTCCAAGATCGAAGCCGACCCGGCTAACCCGGTTCACTTGGTGACGGTGCGCGGGCTGGGCTACAAACTC
GAGGGCTAGCGGACGCCGACAACCTTGGCGACTGTCTGGTCGGCTACGGCCAGTGCCATCGCCATGATGGACAGCTGCGG
GTTCACTTCCGGGCAGCTGGGCAGGATCGAGGCGTCGGCAACCCACACGCCCTCGACGCCGCGCAGCCGGCCCGTCGCGT
CGACCGGACAAAGCTGCTCGTCGGCGCCGGCGGCCGCGGTGCCCGTCGGATGGAAGGCGGCCAGGTGCAGGCTTCTGGGG
TTGGCTCGGCGCAGCACATCCTGCAGCTCGGGCAGGGACCGCATCGGTGGGGCGCCGGGGATACCGGTCAGCACCTCCAC
CGCGCCGGCGGCAAAGAGCAGCCGGCCAATGGCCTGCAGCGCGACCCGTAGCTTGGCGATCTCACCTGGAGCTATGTCAT
AGCGCACCACCGTCTCGCCGCGCACCGACCGCACCGTGCCGACGCCCGATCGGCCACCATCGCCCGAATGTTGCGATC
TGCGGCGCCCGGTCGAGCCAGCGGAGCAGCTCGGCCCCGTAGCCGGGGAAGACCATCGACCCATGCCCGGCGGTGTGGA
GGTGGCCTCGATCAGCACGCCGTCGGATTCGTGAAACTCGTGAACCGCCGCGCTCTGCAGCACCCCGCGCCACGCGAAGA
CGTCGTCGTCGAAGAGCCCGGCCAGCATAGTTGCCGGGTGCAGCGCAAGGTTGTGGCCCAGTCGCGGGTGCCCACCAAGA
CCGCTGCGCCGCAACAGTCCTGGCGTCTCCGTCGCACCGGCGGCGACGACGACCGCGTCGGCCAGCACGTCGAGTGTGGT
GCCGTCGGGCCGGCGGGCTCGCACGCCATAGGCCCGCCCGGCCGGTGCAGGATCCGTTCGACCCGCGCCAGGAGATGA
TCCGCGCGCCGGCCGCGCAGGCTTGCGGCAGGGCGTTGAGGTGCACGCCGAACTTGGCGTTGCTGGGGCAGCCGATCGCG
CACTGGCAACAGCCACGGCACCCCGGCGCATTGCGCGGGATGGGCGCTGCCCGCCAGCCCAGCGACTTGGCGGCCTGCAG
CAACAGGCGCCCGTTGCGGCCCATGATCTCCAGCGGCACCGGCGCAACCCGCAGTGTTTGCTCCGCATCGTCAAGACGAC
GTCCCAGCTGGTCGGGGTCGGCCAGGCCGAGACCGAACTCGTCACGCCAGCGCCGCTGCACGGCAAGTGAAGGCCGAAAG
CAGGTGCCGGAGTTGACGACGGTGGTGCCGCCCACCGCCCGGCCCATCGGCAGCACCACCGCCGGTCGCCCGAGCGCGAC
GGTGGCCCCGGCGCCACGGTACAACCCGGCATAACGGTCGACCGGGTGGGTGCTACGGAACTCCTCGACCGTCCAGCGCC
GTCCCTCTTCGAGCACGACCACGTCAAGGCCGGCCCGGGCCAGCGTGCGCGCCGACCATCGCGCCGCCCGGAGCCG
ACGACCACCGCATCGGCCCTGGTGACGGATGGGCTGTCCGCCGACAAGATGACGGTCAACTCCGCGTCGGGGCGCGCCGC
GTCATGTTCCTGGGCGCGGGCGAGCAATTCGTGCGCGTAGGTGTCGGCGCCGTTGGCCAACAGCACGATCGCCTTCAACC
CCTCCACGGCCGCAGCGACTTCCGGGCTCAGTGCGGCGATCCGGTGCAGCACCCGTGCCCGCTCGTCCGGGTGCAGTCGC
GGTAGCGACCGGCCGGTGGTGAGGTAGCTGGCCGCCGCCAGTGAAGCCAGCCCGGCGCGCACCGCGAATCGTGAGGTCGC
CGGCAGTCGTGTGACGTAGCGGTCAACGCGCTGCACGAATTGAGCCGGCAACGGGCCGCCGAGCTCCGGCGGCAGCAGCG
CGGCGCCGAACGAGGCCAACGGATAGGACTTAGCCCGATCGGCGAGCCGGCTCATATCCGGCGCCCGAGCCGGCGGCCGA
GCTTTATGAAGAACGGATACGTTGCGAAGATGGCAGCGGCCATCGCGTGCAGCGGCCACTCCGCGCGGGCCACATCCACG
CTGAAAACCCCGCTGTTCCACATGAAATCGCGCCGTTCTGTGCGCGAAATGGCCGCCACAGCATCCCGAGCCCGGGTAC
GTTGTGGTACAGCCCGAACGAAGCGCCGAAGAAGACGCCCAGGGCGGCGGCCTCGGCGGCATCGCGGCGGTCCACGGGCA
GGCGTCGCTCGATGAGCACTCCGCAGACAAACAGCAGCGGCGGGTCGAGCAGGAAACTCATGCTGGCGTCCCTTCCTTGA
TAGCCGGTGCCGCGGTTCCCCGCAGGCCGACTTCGGCGTGTCCGGTGCCCAGCACCGACCAGTGCCGGCCGCCGAGCTCG
ATGTGGATGTCGGCCTGCTCGGTGTTGGTGCACACCGCCTTGGCCCCGTCGGGATCGGTGTATCCCAGGCTTACGCACCG
CTCCGGCGGCTGGTCTACCCGGATTAGCGCCTCCCGGCCGCCGATGCGTCCTTCCAGTTGCCAGTGCCGCACGCCGAGCG
TTGTCCGCATTCGCAGCGACGGTAAAGGACTTGCGGGCCAATCCTTTCCGTCGATGCGGAAGCGAACGAACGCTAGCGGC
GCGAGCCTGCGTAGGCCCGGCTTGTGTGATACCGCGGTCACCACCTCTAGGACGTCGCCGTCGCCGAGATCGGCATGGAT
CCATCCCCACCGCTTGGCATTGCCATGTCCGTAGATGTGGGCCACACTGCCGCGCCAGCTGTCGACGCGGTGGGTGGTTT
CGCCGACGGCCAAGGAGCCAGCGAAGACGGCGGTGGGTGCGATCACCACTTGGGCGCCGGGCAGCAACTCGCGCTCCCAG
GCCACGCGAGGAAACGTCCACAGTGGCGCCGCGGTGTCCTTCCAGGACAGCTCCCATGCGAGTGATCGGGTACGTCCGGT
CAGCTCCGCTGGCGCCATTCGTACACCGGCGATGTCGAACCAGGCGGGGCCGGCCGCGGGTTGGGCGGGCTGGGGGCCGA
AGCGCTCGGTGCCCGGCGGGGCATCCGGTGGAAACCAGGTCACCCAGCCGTGCGCGTAGGGCCCGCCGGTCGTCGGGGCC
ACCGTCTCACAGTGCACCCATAGGCCGGTACGCGTCAGTGGATCCGACAGAGTCGCATACCAGACTTCCAGGCGCCCGGC
TGCACCGCGCCACCGCGGCAAGGCCGCGACCGCGTTTCATCGTCCACTGCGGCACCTCCTGCTGGCTGAGTTGTCGATT
CGCCCACTATATTGGTTGAGCCAATGAACCAGTCAAGTGTCTTTCAGCCGCCGGATCGGCAGCGGGTGGATGAGCCGATC
GCGACGACGATCGCCGACGCCATCCTCGACGGCGTCTTCCCGCCGGGCTCGACCCTGCCCGCCGAGCGAGACCTGGCAGA
GCGGCTCGGTGTCAACCGCACCTCGCTACGCCAGGGTCTGGCGCGACTGCAACAGATGGGCCTGATCGAGGTGCGGCACG
GCAGCGGCAGTGTGGTCCGTGACCCCGAGGGGCTCACCCATCCCGCGGTGGTCGAGGCGCTGGTGCGCAAACTGGGCCCC
GACTTCCTCGTCGAGTTGCTGGAGATCCGCGCGGCGTTAGGCCCGTTGATTGGCCGCCTGGCGGCCGCCCGGAGCACGCC
```

FIGURE 7(continued)

```
CGAGGATGCCGAGGCGTTGTGTGCGGCGCTGGAAGTGGTGCAACAGGCGGACACGGCCGCGGCGCGGCAGGCAGCCGATC
TTGCCTACTTCCGGGTGCTCATCCACAGCACTCGCAACCGCGCATTGGGGTTGCTCTACCGCTGGGTGGAGCACGCCTTC
GGCGGCCGCGAGCATGCGCTCACCGGGGCCTACGACGACGCGGACCCAGTGTTGACCGACCTGCGGGCGATCAACGGGGC
GGTGCTGGCCGGTGACCCGGCGGCGCTGCCGCGACCGTCGAGGCGTATCTGAACCGCCAGTGCGCTGCGCATGGTCAAGT
CCTACCGCGACCGCGCTTAGCTACTGGGCCGCACGCGTCGCCGGATGTACGGCGATGAGCCCTAATTGACTGCGGCGCTT
GCACATTGCTGCGAGTTCCCCATAGGCCTTCTCCCCGAGTAATTCGGTGAGTTCGTCGGCAAGGCTCTGCCACACCTGCT
TGGTTCCGACATGGGCGGCCGGATCGCCGGTGCAATACCAGTGCAGGTCAGCACCACCCGAGCCCCAACCGCGGCGGTCA
TATTCGGTGAGGGTGGTCTTGAGGATTTCGGTGCCGTCGGGGCGGGTCACCCATTCCTGGCTGCGCCGGATCGGCAACTG
CCAGCAGACATCGGGTTTCATCGTCAACGGCGGCACGCCCAGCTTGAGGGCTTTGCTGTGCAGCGCGCAGCCGGCGCCAC
CGGCGAACCCGGGCCGGTTCAAGAAGATACACGCGCCCTTGTGTTTGCGGGTGCGGTGCTGGGGTTGGCCGTCGTGCTCG
TCGAGTTCCAGGTAGCCCTTGCGGCGCAGGCCCTTTGCCCGGAACTGCCAGTCGTCGTCGGTCAGCTTGTGCACCGCGTC
GGCCAACCGGGTGCGGTCGTCGTCGTCGGACAGGAACGCACCGTGCGAACAACAGCCGTCGTTTGGCCGGCCCGCGACGG
TGCCCTGGCAGGCGGGTGTGCCGAATACACACGCCCAGCGCGACAGCAACCAGGTAAGGTCGGCCGCGATCAGGTGCTCG
GGATTGTCCGGGTCGTAGAACTCCACCCACTCACGGGCGAAGTCCAACTCGACTTCTTGCCCCGGGTGCACCGGTCTCCG
TCGCGAATTTGCCACGGATTCAACGTTAGACCACGAAGCCCGCCGCGGGATTCCGCCATAGCCCAGCACGGCCGGCACAT
GCCACCGGGCGCCTTGCGCGGGTCGCCACACGCCCGTATCTTCGCCCGGCTAGTTTGTTTTCGTGCGATTGGGCGTGCTG
GACGTGGGTAGCAACACGGTCCATCTGCTGGTGGTCGATGCCCACCGCGGCGGCCACCCGACCCCGATGAGCTCGACGAA
GGCCACGCTGCGGCTGGCCGAGGCCACCGACAGCTCGGGCAAGATCACCAAGCGCGGAGCCGACAAGCTGATTTCCACCA
TCGACGAATTCGCCAAGATTGCCATCAGCTCGGGCTGTGCCGAGCTGATGGCCTTCGCCACGTCGGCGGTCCGCGACGCC
GAGAATTCCGAGGACGTCCTGTCCCGGGTGCGCAAAGAGACCGGTGTCGAGTTGCAGGCGCTGCGTGGGGAGGACGAGTC
ACGGCTGACCTTCCTGGCCGTGCGACGATGGTACGGGTGGAGCGCTGGGCGCATCCTCAACCTCGACATCGGCGGCGGCT
CGCTGGAAGTGTCCAGTGGCGTGGACGAGGAGCCCGAGATTGCGTTATCGCTGCCCCTGGGCGCCGGACGGTTGACCCGA
GAGTGGCTGCCCGACGATCCGCCGGGGCCGGCGCCGGGTGGCGATGCTGCGAGACTGGCTGGATGCCGAGCTGGCCGAGCC
CAGTGTGACCGTCCTGGAAGCCGGCAGCCCCGACCTGGCGGTCGCAACGTCGAAGACGTTTCGCTCGTTGGCGCGACTAA
CCGGTGCGGCCCCATCCATGGCCGGCCGCGGGTGAAGAGGACCCTAACGGCAAATGGTCTGCGGCAACTCATCGCGTTT
ATCTCTAGGATGACGGCGGTTGACCGTGCAGAACTGGAAGGGGTAAGCGCCGACCGAGCGCCGCAGATTGTGGCCGGCGC
CCTGGTGGCAGAGGCGAGCATGCGAGCACTGTCGATAGAAGCGGTGGAAATCTGCCCGTGGGCGCTGCGGGAAGGTCTCA
TCTTGCGCAAACTCGACGCGAAGCCGACGGAACCGCCCTCATCGAGTCTTCGTCTGTGCACACTTCGGTGCGTGCCGTC
GGAGGTCAGCCAGCTGATCGGAACGCGGCCCAACCGATCGAGAGGCAGCAAACCATGACGGGACCACACCCCGAAACAGAG
AGCTCCGGTAACCGGCAGATCTCGGTGGCCGAGTTGCTGGCCAGGCAAGGGGTCACCGGCGCCCCGGCCCCGACGGCGCCG
GCGGCGACGCGGCGATAGTGACGCCATCACGGTCGCCGAGCTGACCGGTGAGATTCCGATCATTCGTGACGACCATCACC
ACGCCGGCCCGGACGCGCACGCGAGCCAGTCTCCGGCGGCTAACGGGCGAGTCCAGGTTGGCGAAGCTGCCCCACAGTCG
CCGGCGGAACCAGTCGCCGAGCAGGTTGCCGAAGAGCCAACGAGAACCGTGTACTGGTCGCAACCCGAGCCGCGCTGGCC
CAAGTCCCCCCGCAGGACCGGCGCGAGTCCGGGCCCGAGCTTAGCGAGTACCCGCGGCCACTGCGCCACACGCATAGCG
ACAGAGCACCCGCGGGGCCGCCGTCCGGTGCCGAACACATGAGTCCGGATCCGGTCGAGCACTACCCCGATCTCTGGGTG
GATGTCCTGGACACCGAGGTGGGCGAAGCGGGAAGCCGAGACCGAGGTGCGCGAAGCGCAACCTGGGCGCGGCGAGCGCCA
CGCCGCAGCGGCGGCGGCCGGCACCGACGTCGAGGGTGATGGTGCGGCCGAGGCGCGGGTTGCCCGTCGTGCCCTGGACG
TGGTCCCGACGCTGTGGCGCGGCGCGTTGGTCGTGCTGCAGTCGATCCTGGCCGTTGCCTTCGGTGCCGGGTTGTTCATC
GCCTTCGACCAGTTGTGGCGCTGGAACAGCATAGTGGCGCTAGTGCTATCGGTGATGGTCATCCTTGGCCTAGTGGTCTC
GGTGCGGGCAGTCCGCAAGACCGAAGACATCGCCAGTACGTTGATCGCGGTTGCGGTGGGGCGCTGATTACCCTGGGAC
CGCTGGCCTTGTTGCAATCGGGCTAGCCGCCACCACACACAGTGCGCCCAGCAATCAAAGTCGGCTTGTCGACGGCCTCG
GTGTACCCGTTGCGGGCCGACGCCGCGTTCGAGTACGCCGACAGGCTTGGCTACGACGGGGTCGAGCTGATGGTCTGGGG
TGAATCGGTCAGTCAGGACATCGATGCGTCCGGAAGCGTGTCGCCGCCGCTACCGCGTGCCGGTGTTGTCGGTGCACGCTC
CGTGCCTACTCATCTCGCAGCGGGTGTGGGGCGCCAATCCGATCCTCAAGTTGGACCGCAGTGTGCGGGCCGCCGAACAA
CTGGGCGCGCAAACGGTCGTCGTGCATCCGCCTTTCCGCTGGCAACGACGCTACGCCGAAGGGTTCAGCGATCAGGTTGC
CGCCCTAGAAGCGGCCAGCACCGTGATGGTGGCCGTTGAAAACATGTTTCCCTTCCGAGCGGACCGGTTTTTCGGGGCCG
GCCAGTCCCGGGAACGGATGCGTAAGCGGGGTGGTGGCCCAGGTCCGGCGATCTCGGCGTTCGCGCCGTCCTACGACCCG
CTGGACGGCAACCACGCGCATTACACGCTGGACCTCTCGCACACCGCGACTGCGGGCACCGACTCGCTGGATATGGCGCG
GCGGATGGGCCCAGGGCTGGTGCACCTGCACCTGTGTGACGGCGAGCGGCCTGCCCGCCGACGAGCACCTGGTGCCCGGCC
GCGGTACCCAGCCGACCGCCGAGGTGTGCCAGATGCTGGCCGGCAGCGGCTTCGTCGGCCACGTCGTGTTGGAGGTGTCC
ACCTCAAGCGCGCGTTCGGCCAATGAACGCGAATCCATGCTGGCCGAGTCGTTGCAGTTCGCCCGCACTCACCTGCTGCG
TTGATATGCCGGGAACACTATGAACGCGTTGTTCACCACGGCGATGGCGCTGCGCCCGCTTGACTCCGATCCCGGCAATC
CGGCGTGCCGGGTTTTTGAAGGCGAGCTGAACGAGCACTGGACCATCGGGCCCAAGGTGCACGGCGGTGCGATGGTGGCG
CTGTGTGCCAATGCCGCCCGCACCGCTTACGGCGCGGCCGGACAGCAGCCCATGCGGCAACCGGTCGCAGTGTCGGCGAG
CTTTCTGTGGGCGCCGGATCCGGGACGATGCGGTTGGTGACGTCGATCCGCAAGCGTGGTCGCCGGATTAGCGTGGCCG
ATGTCGAGCTCACCCAGGGTGGCCGCACAGCGGTGCACGCCGTGGTCACCCTGGGTGAGCCGGAGCATTTTCTCCCCGGC
```

FIGURE 7(continued)

```
GTTGATGGGAGCGGCGGGGCCAGTGGAACCGCGCCGCTGCTGTCGGCGAATCCGGTGGTGGAGCTGATGGCACCGGAACC
GCCCGAGGGAGTCGTGCCGATCGGTCCCGGCCATCAGCTGGCCGGGCTGGTGCACTTAGGCGAAGGCTGCGATGTCCGGC
CGGTGTTGTCGACGTTGCGGTCCGCGACCGATGGGCGGCCACCGGTGATTCAGCTGTGGGCGCGTCCACGCGGCGTTGCT
CCGGACGCGCTGTTCGCTCTGTTGTGCGGGGACTTGTCGGCCCCGGTGACCTTCGCGGTGGACCGCACCGGCTGGGCGCC
TACAGTTGCGCTCACCGCCTATCTTCGGGCCCTGCCCGCCGACGGCTGGCTGCGAGTGCTCTGCACCTGCGTCGAAATCG
GGCAGGACTGGTTTGACGAGGACCACATCGTCGTCGACCGGTTGGGCCGCATCGTGGTGCAGACGCGCCAACTGGCGATG
GTGCCTGCCCAGTAGCACGGATCGGCCGAGCTGTCTGCGATGCTTTTCGGCATGGCAAGGATCGCGATTATCGGCGGCGG
CAGCATCGGTGAGGCATTGCTGTCGGGTCTGCTGCGGGCGGGCCGCCAGGTCAAAGACCTGGTAGTGGCCGAGCGGATGC
CCGATCGCGCCAACTACCTGGCGCAGACCTATTCGGTGTTGGTGACGTCGGCGGCCGACGCGGTGGAGAACGCGACGTTC
GTCGTCGTCGCGGTCAAACCAGCCGACGTCGAGCCGGTGATCGCGGATCTGGCGAACGCGACTGCGGCGGCCGAAAACGA
CAGTGCTGAGCAGGTGTTCGTCACCGTGGTAGCGGGCATCACGATCGCGTATTTCGAATCCAAGCTACCGGCTGGGACGC
CAGTGGTGCGTGCGATGCCGAACGCGGCGGCATTGGTGGGAGCGGGGGTTACAGCGCTGGCCAAAGGCCGCTTTGTCACC
CCGCAACAGCTTGAGGAGGTCTCGGCCTTGTTCGACGCGGTCGGCGGCGTGCTGACCGTTCCGGAATCGCAGTTGGACGC
GGTGACCGCGGTGTCCGGCTCGGGTCCGGCCTATTTCTTTCTGCTGGTCGAGGCCCTGGTGGATGCCGGAGTCGGGGTGG
GCTTGAGCCGTCAGGTGGCCACCGATCTCGCCGCGCAGACAATGGCTGGCTCAGCGGCGATGCTGCTGGAGCGGATGGAG
CAAGACCAGGGTGGCGCCAATGGCGAGCTGATGGGGCTGCGCGTGGACCTTACCGCATCACGGCTGCGCGCCGCGGTTAC
CTCGCCGGGCGGTACGACCGCCGCTGCGCTGCGGGAACTCGAACGCGGCGGGTTTCGGATGGCTGTCGACGCGGCGGTTC
AAGCCGCCAAAAGCCGCTCTGAGCAGCTCAGAATTACACCGGAATGATTCACGAATTTTGAACTGATTATCCCTCACCAG
TACCAGTAACCCCACTAGTCCCGCTATTCTCCTCTTTGTAAGCGCGTGTGGGTGCCAGCGGAGGGGAAGCCGCTGGGACT
GCGCGTGCCTGACACGATTGGGTTGCGATGACGTCTACGAACGGGCCATCGGCGCGGGATACCGGTTTTGTTGAGGGCCA
GCAGGCCAAGACACAACTTCTCACCGTGGCCGAAGTGGCGGCCCTGATGCGGGTGTCCAAGATGACGGTGTACCGGCTGG
TGCACAATGGCGAACTGCCCGCGGTTCGGGTCGGGCGGTGCATTCCGGGTGCATGCCAAGGCCGTCCACGACATGTTGGAG
ACTTCGTACTTCGACGCGGGCTAGTTGCCGGCCGCACGCGGCCGGAGTCCGCCTGACCGATCTGGCAATGCTCGGGCGCT
GCCGGTTTGGTGTTCCGTGCGACCGCCCGGGTAGAGTGTCCGGGTCAGATAGCCGTATAGATGGCGGGGTCATGGGTTCA
GTAATCAAGAAGCGGCGCAAGCGCATGTCCAAGAAAAAGCATCGCAAGCTGCTGCGTCGCACCCGGGTGCAGCGCAGGAA
ACTGGGCAAATAGGTTGCGAGCAGACCCCGCCAGCTCGACCGTCACGCGCTTGTAACGCCGCCGTTTCGCCTGGCCGTTA
GGCTGTCGGAGTGAGTTCGTCGAACGGGCGCGGTGGCGCCGGAGGAGTCGGCGGCAGCAGTGAGCACCCGCAGTACCCA
AAGTTGTGCTGGTGACCGGTGCTTGCCGTTTCCTAGGCGGCTACCTGACCGCACGGCTTGCCCAGAACCCGCTGATCAAC
CGGGTCATCGCGGTGGACGCGATCGCGCCGAGCAAGGACATGCTGCGCCGGATGGGCCGGAGCCGGAATTTGTTCGCGCTGA
TATCCGAAACCCATTCATCGCCAAGGTGATTCGCAATGGCGAGGTGGACACGGTGGTGCACGCCGCGGCGGCCTCGTATG
CGCCGCGGTCCGGCGGCAGTGCGGCATTGAAGGAACTTAACGTGATGGGCGCGATGCAACTGTTCGCCGCCTGCCAAAAG
GCGCCCTCGGTCCGCCGGGTCGTGCTGAAGTCGACCTCTGAGGTTTACGGATCGAGCCCACACGATCCGGTGATGTTCAC
CGAGGACAGCAGCAGTCGACGTCCTTTCAGCCAAGGTTTCCCTAAGGACAGTCTCGATATCGAGGGCTACGTGCGCGCGC
TGGGCCGACGCCGCCCGATATTGCAGTGACTATCCTGCGGCTGGCCAACATGATCGGCCCGGCGATGGACACCACGCTT
TCACGATATCTGGCCGGGCCGCTGGTCCCGACGATCTTCGCCGTGATGCGCGACTGCAGTTGCTGCACGAGCAGGATGC
GCTGGGTGCGTTGGAGCGCGCGGCGATGCCGGCAAGGCCGGAACGTTCAACATCGGAGCCGACGGCATCCTCATGCTGT
CGCAGGCGATCCGGCGGGCCGGGCGAATTCCGGTGCCGGTGCCAGCGGTTTGGGGTATGGGCTCTGGATTCGCTGAGGCGA
GCGAATCACTACACCGAGCTGAATCGTGAGCAATTCGCTTACCTGAGTTATGGCCGGGTTATGGACACCACCAGAATGCG
CGTCGAACTGGGTTACCAGCCGAAGTGGACGACCGTCGAGGCGTTCGATGACTATTTTCGCGGCCGCGGCCTGACTCCCA
TTATTGACCCACATCGGGTACGCTCCTGGGAGGGTCGCGCCGTAGGTTTAGCGCAGCGCTGGGGTAGCCGAAATCCAATT
CCATGGAGCGGACTCAGATAGGGTTTGGATGGGTAACGTGGCGGGCGAAACCAGAGCGAATGTCATTCCACTGCACACAAA
TCGGAGCCGGGTAGCGGCGCGCAGGCGTGCCGGTCAACGGGCAGAGTCCCGGCAGCATCCGTCGTTGCTGTCCGATCCAA
ATGACCGGGCGTCGGCCGAGCAGATCGCCGCCGTTGTCCGGGAAATCGACGAACACCGGCGCGCTGCGGGTGCCACGACC
TCGTCCACCGAGGCCACGCCCAACGACCTTGCGCAACTCGTCGCCGCGGTTGCTGGATTTCTCCGACAGCGCCTGACCGG
TGACTACAGCGTCGACGAATTCGGGTTCGACCCGCACTTCAACAGCGCCATCGTACGACCCTTGCTGCGATTCTTCTTCA
AGTCATGGTTTCGGGTCGAAGTCAGTGGTGTCGAGAACATCCCGCGCGATGGTGCGGCGCTGGTGGTGCCAATCACGCA
GGTGTGTTGCCGTTTGACGGGTTGATGTTGTCGGTGGCCGTCCACGACGAGCACCCGGCGCATCGGGATCTGCGGCTGCT
TGCCGCCGACATGGTGTTCGACCTTCCCCGTGATCGGCGAAGCCGCCCGCAAGGCGGGTCATACCATGGCGTGTACGACGG
ATGCGCACCGGTTGCTTGCCTCCGGCGAACTCACCGCGGTGTTCCCCGAGGGATACAAGGGGCTGGGTAAGCGTTTCGAG
GACCGTTACCGGTTACAGCGGTTTGGTCGCGGCGGCTTCGTATCGGCCGCGCTACGGACCAAGGCGCCGATTGTGCCGTG
TTCGATCATCGGCTCCGAAGAGATCTACCCCATGCTGACCGATGTCAAGCTGCTGGCTCGGCTGTTCGGCCTGCCGTACT
TCCCGATTACGCCGTTGTTCCCGTTGGCTGGACCGGTCGGGCTAGTGCCGTTGCCCTCGAAATGGCGCATCGCGTTCGGT
GAGCCGATCTGCACCGCCGACTACGCCTCCACCGACGCCGACGACCCGATGGTGACGTTCGAGTTGACCGATCAGGTGCG
CGAGACGATCCAGCAGACGCTATACCGACTGCTTGCCGGCCGTCGCAACATCTTTTTCGGCTGACCCTTATTTGACCAGA
GTGAACTGGCAGACGTCCGTGTACTTGTCGCGGAACAGGTCTGAGCAGCCACGTAGGTAGTGCATGTAGATGTCGTACGT
CTCCTGGCCCTTGAGGGCGATCGCCTCATCTTTGTGCGCCTGTAGCGCATCCGCCCAGGCGTTCAGGGTCGGCACGTAGT
```

FIGURE 7(continued)

```
TGGCCCCGATCCGGTGGTAGCGCTCGACCTTCCATCCGGCGTTGGAGGAGTAATAGTCCACCTGCGAGATCCTGGGCAGC
CGCCCGCCGGGAAGATCTCGGTCAGGATGAACTTGATGAAGCGCAGCAGGCTCATCGGAGACGTCAAGCCCAGCTCCTG
GGCTTCCTCTTTGTCCGGGATAGTGATGGTGTGCAGCAGCATCCGGCCGTCGTCGGGCGTCAAATTGTAGAACTTCTTGA
AGAAGGTGTCGTAGCGCTCGAACCCGGCGTCCCCGGCACCGTCGGCGAAATGCTCAAACGCACCGAGTGACACGATGCGG
TCGACCGGCTCGTCGAACTCCTCCCAGCCCTGGATTCGCACCTCTTTTCGGCGGGGGCTGTCGACCTCATCGAACATCGC
CTTGTCGTGGGCGTACTGGTTTTCGCTCAGGGTCAAGCCGATGACGTTGACGTCGTACTCGGCGACCGCGTGTCGCATGG
TGGAACCCCAGCCGCAGCCGATGTCGAGCAGCGTCATGCCGGGCTCAAGGTTCAGCTTGTCCAGTGCCAGCTTGCGCTTC
GCGTACTGCGCCTCTTCCAGCGTCATATCGGGACGTTCGAAGTAGGCGCAGCTGTACGTCATCGATGGGTCAAGCCAGAG
CTTGAAGAACTCGTTCGATTTGTCGTAGTGGGATCGAACTGCTTCGACCGGCGGCTTGAGCTGCGTGCCGCTTGTCGTGT
CGCCCTGTGACGTCATTGAACGGACCCTACTTTCCCCACTAGATCGATGCAATCGCCGCCACCGTTGCATCGGCATCGGC
TTCGTGGTGGGCCGCTTCTCCCAACATGGTGACGACACTGGTGACCACAGGCTTTCCTTCGGCGTCGGTAACTTCGCTTC
GGATCTCGGCGAGCACCGTGCCGTGGGATTCGATGACGGAGTCAAGATAGGTGTCGAAGTACAGCTTGTCGTTGGCCAGG
ATCGGCCGGTGGAAGCGGAACTTCTGGTCGCGATGAAAGACCCGGGCGATGTTGATCGGGATATTGAACTTGGTGAAGAT
CTCCAGCTGCACGCGCCGGCCGGCGATCGCCAGGAAGGTCAGCGGGGCTACCAGCGCGGGGTAACCGGCCGCTGCGGCAT
CCGGCTCGCTGTAGTGGGTCGGGTGGTCGTCTTTGACCGCGACCGCGAACTCGCGGATCTTCTCGCGCCCCACCAGAAAG
TGGTCCGGCGCCCGATAATGCTTGCCGATCAGTGTCTGGGCTTCTTCGGGAACTGTCATGCCGCTGCCGCCCTCCGCTCG
AATAGTTGCTAAGCCCTATTGCCCGGCTCCTCCTCGCCCCGCTGCGCGGGTCGATCGTCGCCAGGCTGGGCCCTATTGC
CCGGCTCCTCCTCGCCCCGCTGCGCGGGCCGCATCGTCGCCAGGCTAACGGCGCAGCTTATCAGCGTGATTGGCGTCTAG
AGGCTAGAGCCGCCAACGCGCCGCCGGCCGCACCCAGCGCCAGGGCCGACGGAACCCCGATCCGAGCGGCCTTGCGGGCG
ATTCGGAAATCACGGATCTCCCACCCCCGTTCCCGGGCCAGGCTGCGCAGGCGGGCGTCGGGGTTGATGGCGACCGCGGT
GCCCACCAGCGACAGCATCGGGACGTCGTTGTAGCTGTCGGAGTAGGCGGTGCAGCGTTTGAGATTGAGTCCCTCCCGGA
TGGCCAGCGACCGCACCGCGTGTGCCTTGCCGGTGCCGTGCAGGATCTCGCCGACCAGTCTGCCGGTGAATATCCCGTCG
ACCGACTCGGCGACGGTGCCCAGGGCGCCGGTTAGGCCGAGCCGGCGGCGATGGTGGCCGCGAGTTCGTATGGGGTAGC
GGTGATCAGCCATACCTGCTGGCCGGCGTCCAGGTGCATCTGGGTGAGTTCGCGGGTGCCGTCCCAGATCTTGTCGGCGA
TGATCTCGTCGTAAATCTCCTCTCCCAAGGCCACCAACTCCGCGACGGATCGGCCCTCGATGAACGCGAGCGCCTTGCGC
CGGCCAGCGGCGACGTCGTTGCTGTTCTCCTTGCCAAGTAGCTGGAACTTGGCCTGAGCGTAAAGAAATCCGAGGACGTC
GCGGTAGGTGAAGTAGTGGCGAGCGGCTAGCCCGCGGCCGAAGTGCACCGCCGACGAGCCCTGAACCAAGGTGTTGTCCA
CGTCGAAGAAGGCGGCTGCGGTCAGGTCGATCGGCGGCTGCCGATCGCTGCCGGCGGCGGCGACGGGGGCCGGCATGTCC
ACCGGCGAGTGGCTGGCGCTGGCATCGGGTGGCGGCGGGTCGGCCGGCGAAGCCAGGTCGACGTGACCGGCCTGGTCTGG
GCTACCCAGGTGGGAGGAAACCATCATTACTCCTAATCGCGGTGCCTGCCCGGTGGCCGATGCTGCGGCCGTTATCAACC
CTATCCGGCAAATGCGCGGCGGAGCTCTTGGCTGGCGCGGATTGATCTGCAAGCCCAGCGCGGTATCGAAATTCGCGAGG
CCGCAGCGACTTTCGTCGTGAACACGACCCGCAGCGGTTCGGGGCCAACATGTCAGCCCCATACCGGTACGCGCAAAGCT
GGGTACGTGAAATCCTGAATTCTTCAGCCTGTCAACGGTAGCGTCTACGCTAGCTAACGCAACGAGACATCCGATTACTA
CGCACGTTAGGACATTTCAGGAGGTATCGGGAGGCCTAAGGGTCACTAGGTCCGCGCGATGGGCGGAACACGAGGGTGAG
GATGATTTCGGTTAGCGGCGCCGTGAAACGCATGTGGTTGCTGCTGGCCATCGTCGTGGTGGCCGTTGTCGGGGGCTTG
GTATCTATCGGCTGCACAGCATCTTCGGTGTTCACGAGCAACCCACTGTCATGGTCAAGCCTGATTTCGACGTCCCGCTG
TTCAACCCCAAGCGGGTGACCTACGAAGTCTTTGGCCCCGCCAAGACCGCAAAGATCGCCTACCTGGACCCTGATGCCCG
GGTGCATCGACTCGATAGCGTGTCCCTGCCGTGGTCCGTCACGGTCGAGACGACGCTGCCCGCGGTCAGCGTCAACCTCA
TGGCGCAGAGTAACGCCGACGTGATCAGCTGCCGGATCATCGTCAACGGCGCCGTTAAGGACGAAAGGTCTGAGACCTCG
CCGCGAGCGCTAACCTCCTGCCAGGTGTCATCCGGATGAGCGAAAGACACGCCGCACTGACGTCACTGCCGCCCATTCTG
CCGCGGCTGATCCGCCGGTTTGCGGTGGTGATCGTCCTGCTCTGGCTGGGCTTCACCGCCTTTGTCAATCTCGCCGTACC
GCAACTGGAAGTGGTCGGAAAAGCACACTCGGTATCGATGAGCCCCAGCGACGCCGCATCGATTCAGGCGATCAAGCGCG
TTGGTCAGGTGTTCGGTGAGTTTGATTCCGATAACGCGGTAACGATCGTGCTGGAAGGCGACCAGCCACTCGGTGGGGAC
GCGCACCGGTTCTATAGCGATCTGATGCGGAAGCTTTCCGCCGATACCCGCCATGTCGCGCACATCCAGGACTTCTGGGG
GGATCCGCTGACAGCGGCGGGATCCCAAAGTGCGGATGATCGGGCCGCCTACGTCGTGGTGTACCTCGTCGGTAACAACG
AAACCGAAGCGTATGACTCGGTCCACGCGGTGCGGCACATGGTGGACACCACACCGCCACCGCACGGGGTGAAGGCCTAT
GTCACCGGTCCGGCAGCACTCAATGCCGACCAGGCCGAGGCCGGAGACAAAAGTATCGCTAAGGTCACCGCGATCACGAG
CATGGTGATCGCAGCAATGTTGCTAGTGATCTATCGCTCCGTAATTACCGCGGTTCTCGTCTTGATCATGGTCGGCATCG
ACCTCGGCGCAATCCGCGGATTCATCGCCTTGCTCGCCGACCACAACATTTTCAGCCTTTCAACATTTGCGACCAACCTG
CTCGTTCTCATGGCGATTGCGGCGAGCACGGACTACGCGATATTCATGCTCGGCCGTTACCACGAATCGCGCTACGCCGG
CGAGGATCGGGAAACGGCCTTCTACACGATGTTTCACGGGACCGCCCACGTGATCTTGGGTTCGGGTTTGACCATTGCCG
GCGCCATGTATTGCCTCAGCTTTGCCCGGCTTCCGTATTTTGAAACGCTCGGCGCGCCCATTGCTATCGGCATGCTGGTC
GCGGTCTTGGCGGCGCTCACGCTCGGCCCGGCCGTACTGACCGTGGGCAGCTTCTTCAAGCTGTTCGATCCCAAGCGGCG
GATGAACACTCGGCGGTGGCGCCGGGTGGGAACGGCAATTGTGCGTTGGCCGGGGCCGGTGCTCGCGGCGACATGCTTGG
TCGCCTCCATTGGCTTGCTGGCCTTGCCCAGTTACCGGACAACGTATGATCTGCGCAAGTTCATGCCCGCCAGCATGCCG
TCCAATGTGGGGGATGCGGCGGCTGGTCGACGCTTTTCACGGGCTCGGCTGAACCCTGAGGTGCTGTTGATCGAGACTGA
```

FIGURE 7(continued)

```
CCACGATATGCGTAATCCGGTGGACATGCTGGTGTTGGACAAGGTAGCCAAAAATATCTACCACAGTCCCGGTATTGAAC
AAGTGAAAGCGATAACCCGGCCCTTGGGAACAACCATCAAGCACACTTCGATACCGTTCATCATCAGCATGCAGGGCGTG
AATAGTAGCGAGCAAATGGAATTCATGAAGGACCGAATTGATGACATACTGGTGCAGGTGGCCGCGATGAATACCTCCAT
CGAGACGATGCATCGCATGTATGCACTCATGGGCGAGGTCATTGACAACACCGTCGACATGGATCATCTCACGCATGATA
TGTCGGACATAACGGCTACGCTAAGAGATCATCTCGCGGATTTCGAGGATTTCTTCCGGCCTATTCGCAGCTACTTCTAC
TGGGAAAAACATTGTTTCGACGTTCCGCTCTGCTGGTCGATAAGATCGATATTCGATATGTTTGACAGTGTGGACCAGCT
GAGCGAAAAGCTCGAGTACCTGGTCAAGGATATGGATATTCTGATTACACTGTTGCCGCAGATGCGCGCGCAGATGCCGC
CGATGATATCTGCGATGACGACGATGCGGGACATGATGCTTATCTGGCATGGCACGCTTGGCGCGTTCTATAAGCAACAG
GAGAGGAATAACAAGGACCCCGGCGCGATGGGCCGGGTTTTTGACGCCGCCCAGATCGATGATTCGTTCTATCTGCCGCA
GTCGGCTTTTGAGAATCCGGATTTCAAGCGGGGGCTGAAGATGTTTTTGTCTCCGGACGGCAAGGCAGCCCGCTTTGTCA
TTGCTCTGGAGGGAGATCCCGCAACGCCCGAGGGCATCTCTCGGGTCGAGCCGATCAAGCGGGAGGCTAGAGAGGCCATA
AAGGGAACTCCATTGCAGGGCGCTGCGATCTATCTGGGTGGCACCGCGGCGACGTTCAAGGATATTCGAGAGGGCGCCAG
ATACGATCTGCTGATCGCCGGAGTGGCGGCGATA
```

FIGURE 7(continued)

```
AAGCTTGCCGCGCCGGTGGGTGTCCGCTCGGATTGCCTGGGCGTCGACGCGCCGTTGCCGGCCTGGGCCGAGTCCAGCAC
TTCGCACTATGTGCAGACCAAAGACCCGGTGGTCGCCGCGCTGCGGCAGCGGCTGGCAACGGCGCCGGTGATCACCGAGT
GGTGCGAGTTGCCGACCGGCAGTTCGCCGCGGGCTTACTACGAGAAGGGCCTGCGCGACGTCATCAGGTATCACGTGTCG
ATGACGTCGAGCGTTAACTTCCCCGACCAGACGGCGACCTCGCCGATGGACCCCGCGTTGTACCTGGTGTGGGCGAAGC
TAACGCCGCCGCAGGCTATCGGTACTCGGTCGAAGCGCAGCCGGGGTCGCAAGCGCTAGCGGGCAAGGTCGCGACGATCT
CGGTCACCTGGACCAACTACGGCGCTGCTGCCGCCACCGAAAAGTGGGTGCCCGGCTACCGGCTGGTGGATTCCACCGGA
CAGGTGGTTCGGACGCTGCCGGCAGCGGTGGACCTGAAGACGCTGGTCTCCGACCAGCGCGGCGATCGCAGCAGCGACCA
GCCGACACCGGCGTCGGTCGCCGAGACGGTTCGCGTTGATCTGTCCGGCTTGCCCGCGGGCCACTACACGCTGCGGGCCG
CGATCGACTGGCAACAGCACAAACCGAACGGCTCCCATGTGGTGAACTATCCGCCCATGCTGTTGTCCCGCGACGGCCGC
GACGATTCCGGGTTTTATCCCGTCGCCACGCTCGACATCCACGCGACGCGCAGACCGCGGTCAACGCTTCGTAGGTGGC
TTTCCCGTCGCTGCGGTCCGCTCACTTGCCTTCGGGTGGTTGCGGCGGCTGGTAGCGGGGAAATACCCCGGTGGGCGGCG
GCAGCGCTGTGCCGGGGGTCAGCCGAACACCTACGGCGGCGAACGACCGCTGGTTTGGGGCCTGGCCGAGCAGGTCCAAA
ATTTTGCCGGCCGACTCCGGCATCACCGGCTGGATCAGCAGTGCCGCGATGCGGACTACCTCGCAGGTGACGTAGAGCGT
GGTGCGGAACCGGGCCTGATCGGCTTCGGACTCGCTCTTGCGCAGTACCCACGGCTGCTGCACCGAAAAGTACTTGTTCG
CGTCGCCGAGCATCAGCCAGATCGCCTCCAGCGCCAGGTGCATCGCCTGTGCGTCGAAGTGACCGCGCACTCGCTCCAAC
AAGCCATCGGCGGTCGCAAGCAGCGCGGCGTCGGCGTCGGCGAACTCACCCGGGTTGGGCACCCTGCCGTCAAGGTTTTT
GGCCACCATCGACAACGAGCGTTGGGCCAAGTTGCCGAGCTCGTTGGCCAGATCGGTGTTGATCCGAGTGACGATGGCCT
CGTCGCTGTAACTGCCGTCCTGGCCGAACGGGACCTCCCGCAACAGGAAGTAGCGGACCTGGTCCACCCCGAGCGCTTCC
GCCAGGGCAACCGGGTCGACGATGTTGCCCACCGATTTACTCATCTTCTCGCCGCGGTTGTGCAAGAACCCGTGCGCGAA
GATCCTTCGCGGCAACTCGATTCCGGCTGACATCAAAAACGCCGGCCAATAGACGGCATGAAACCTGATGATGTCCTTGC
CGATCATGTGCAAATCGGCGGGCCAGTAGCGGCGGAACAACTCCGAGTCGGTATCCGGGAAGCCCGCCCCGGTCAGGTAA
TTGGTCAGCGCGTCGACCCAGACGTACATGACGTGGTCGGGGTGCTCGGGCACCTGCACACCCCAGTCAAACGAGGTGCG
CGAGATCGACAGGTCGTCCAGGCCGCCGGAGACGAAGCTGATCACTTCGTTGCGCCGCGTCTCCGGCGCGATGAAGTCGG
GGTTGGCGTGATAGTGGGCCAGCAGCTTGTCGGTATAGGCCGACAGCCGGAAGAAGTAGGTCTGCTCCTCGGTCCAGGTC
ACCGGCGTGCCGGTCTCTACCGTCAGGCGCGTGCCGTCGACAAGTTGGGTCTCCGATTCGACGAAGAACCGCTCGTCGCG
CACCGAGTACCACCCGGAATAGTTGTCCAGATAGATGTCGCCGGCCGCCGACATCCGTCGCCAGAGTTCCTTGGACGCCT
CGTGGTGGTCGGCATCGGTAGTGCGGATGAATCGGTCGAAGGAGATGTTCAGCGCCTCCTGCATGCGCTGAAACACGTCG
GAATTGCGCCGGGCAAGCGCCGCGGTGGGCACGCCCGCTGCCGCGGCGGCTTGTGCGACCTTCAGGCCATGCTCGTCGGT
CCCGGTCAGGAAGCGCACGTCATAGCGATCCAGCCGTTTGAACGGGCGATCGCGTCGGTGGCGATGTATTCGTAGGCGT
GACCTACGTGGGGTGCAGCGTTGGGATATGCGATCGCGGTGGTGACGTAATAGGGCTTCATTTCGACACCACCCTATTGT
GTGCGGGTGAGCTCCGACCGCCCAGCCAGACGAGATCCACCGCCCGCTCCGGAACCCCTGGCGCCGTTGGTCGACGCCCA
CACCCATCTCGACGCGTGCGGTGCACGAGACGCCGATACGGTGCGGTCGCTCGTCGAGCGAGCCGCCGCGGCCGGCGTGA
CCGCGGTGGTCACCGTCGCCGACGACCTGGAGTCCGCGCGCTGGGTCACCCGCGCGGCCGAATGGGATCGGCGAGTCTAT
GCCGCGGTGGCGTTGCACCCGACCCGCGCCGATGCGCTCACCGACGCTGCCCGTGCCGAGCTCGAGCGATTGGTTGCCCA
CCCCAGGGTGGTGGCCGTCGGTGAGACCGGAATCGACATGTACTGGCCGGGTCGCCTGGACGGGTGTGCGGAGCCGCACG
TCCAGCGGGAGGCCTTTGCCTGGCATATCGATCTGGCCAAGCGGACCGGTAAACCGCTGATGATCCACAATCGTCAGGCC
GACCGCGACGTGCTGGACGTGCTGCGGGCCGAGGGCGCGCCGGACACCGTGATCTTGCACTGCTTCTCGTCGGACGCGGC
GATGGCCCGCACGTGTGTGGACGCCGGGTGGCTGCTCAGCCTGTCCGGGACGGTGAGCTTCCGTACCGCCCGTGAACTAC
GGGAAGCCGTCCCGCTGATGCCGGTGGAGCAGCTTTTGGTGGAAACCGATGCACCGTATTTGACCCCGCATCCCCACCGG
GGCTTGGCGAACGAACCGTACTGCCTGCCCTATACCGTGCGGGCGCTGGCTGAACTGGTCAATCGGCGCCCCGAAGAGGT
GGCGCTCATCACCACAAGCAACGCTCGCCGAGCTTATGGGCTAGGGTGGATGCGCCAATGAGCGCGCCGAGCGGCCCATA
ACACCCGCGCGCCGGAGTTGCTCAACATTGGCCGGTTCGTTACCGTCTTGTGATCGAACGGGTGGGGCCTCTAGGTTTCG
GAGGGCCCATTTTGCTTTTTGTTCGCTGTGTAGGTGGTTGAGTGTTGCCGAGGTCGGGGATATAGCGCGTTGACTCTACT
TACCAAACTTCATCAGACCCAATCACCGATGTTGCGCCTGGTAGTCGGTGCGCTGCTGCTGGTGTTGGCGTTCGCCGGTG
GCTATGCGGTCGCCGCATGCAAAACGGTGACGTTGACCGTCGACGGAACCGCGATGCGGGTGACCACGATGAAATCGCGG
GTGATCGACATCGTCGAAGAGAACGGGTTCTCAGTCGACGACCGCGACGACCTGTATCCCGCGGCCGGCGTGCAGGTCCA
TGACGCCGACACCATCGTGCTGCGGCGTAGCCGTCCGCTGCAGATCTCGCTGGATGGTCACGACGCTAAGCAGGTGTGGA
CGACCGTCGACGGTGGACGAGGCGCTGGCCCAACTCGCGATGACCGACACGGCGCCGGCCGCGGCTTCTCGCGCCAGC
CGCGTCCCGCTGTCCGGGATGGCGCTACCGGTCGTCAGCGCCAAGACGGTGCAGCTCAACGACGGCGGGTTGGTGCGCAC
GGTGCACTTGCCGGCCCCCAATGTCGCGGGGCTGCTGAGTGCGGCCGGCGTGCCGCTGTTGCAAAGCGACCACGTGGTGC
CCGCCGCGACGGCCCCGATCGTCGAAGGCATGCAGATCCAGGTGACCCGCAATCGGATCAAGAAGGTCACCGAGCGGCTG
CCGCTGCCGCCGAACGCGCGTCGTGTCGAGGACCCGGAGATGAACATGAGCCGGGAGGTCGTCGAAGACCCGGGGGTTCC
GGGGACCCAGGATGTGACGTTCGCGGTAGCTGAGGTCAACGGCGTCGAGACCGGCCGTTTGCCCGTCGCCAACGTCGTGG
TGACCCCGGCCCACGAAGCCGTGGTGCGGGTGGGCACCAAGCCCGGTACCGAGGTGCCCCGGTGATCGACGGAAGCATC
TGGGACGCGATCGCCGGCTGTGAGGCCGGTGGCAACTGGGCGATCAACACCGGCAACGGGTATTACGGTGGTGTGCAGTT
TGACCAGGGCACCTGGGAGGCCAACGGCGGGCTGCGGTATGCACCCCGCGCTGACCTCGCCACCCGCGAAGAGCAGATCG
```

FIGURE 8

```
CCGTTGCCGAGGTGACCCGACTGCGTCAAGGTTGGGGCGCCTGGCCGGTATGTGCTGCACGAGCGGGTGCGCGCTGACCA
TCCGGCTGCTCGGGCGCACTGAGATCAGGCGGCTGGCCAAAGAGCTCGACTTTCGGCCGCGCAAATCTCTCGGACAGAAC
TTCGTGCACGACGCCAACACGGTGCGACGGGTGGTTGCCGCCTCCGGGGTCAGCCGTTCCGACCTGGTTTTGGAGGTCGG
GCCGGGCCTGGGATCGCTGACCCTGGCACTGCTCGACCGCGGCGCGACCGTCACCGCGGTCGAGATCGATCCACTACTGG
CTTCTCGGCTGCAACAGACCGTGGCGGAGCACTCGCACAGCGAGGTTCACCGACTAACGGTGGTCAATCGCGACGTCCTG
GCCCTGCGCCGGGAGGATCTAGCCGCGGCGCCGACCGCGGTGGTTGCCAATCTGCCGTACAACGTAGCGGTACCGGCGTT
GTTGCATCTGCTTGTCGAGTTCCCGTCGATCCGTGTCGTGACGGTGATGGTGCAGGCCGAGGTCGCCGAACGGCTCGCCG
CCGAGCCGGGCAGCAAAGAGTACGGCGGTGCCCAGCGTTAAGCTGCGCTTCTTCGGGCGGGTTCGCCGCTGCGGCATGGTG
TCGCCGACCGTTTTCTGGCCCATTCCGCGTGTCTATTCCGGGCTGGTACGCATCGATCGATATGAGACCTCGCCCTGGCC
CACCGACGACGCTTTTCGACGGCGGGTATTCGAACTCGTGGACATCGCATTCGCGCAGCGGCGCAAGACTTCTCGCAACG
CGTTTGTGCAGTGGGCGGGCTCGGGAAGCGAGTCGGCGAATCGATTGTTGGCGGCCAGCATCGACCCCGCCCGTCGCGGT
GAGACGCTGTCCATCGACGACTTCGTGCGGCTGCTGCGACGGTCCGGCGGCTCCGACGAGGCCACCAGCACCGGCCGGGA
CGCCAGGGCGCCGGACATTTCGGGGCACGCGTCGGCGAGCTGACGGGGCGCCGCCGCGTGTGGTCGGCGCGTCACAGCGA
TAGTCTGCTGCGGTGTCCGCATCTGACGGCAACACCGCTGAATTGTGGGTGCCCACCGGGTCGGTCACCGTTCGGGTGCC
CGGAAAGGTCAACCTCTATCTGGCGGTCGGCGATCGCCGCGAGGACGGCTATCACGAGCTGACCACGGTATTTCATGCCG
TCTCGCTGGTCGACGAGGTAACCGTTCGTAACGCTGATGTGCTCTCGCTCGAGTTGGTCGGCGAGGGGCCGACCAGCTG
CCGACCGACGAACGCAATCTCGCCTGGCAGGCGGCCGAGCTGATGGCCGAACACGTGGGCCGGGCGCCGGACGTCTCGAT
CATGATCGACAAATCCATTCCGGTCGCCGGCGGCATGGCCGGTGGCAGCGCGGACGCTGCGGCGGTCCTGGTTGCGATGA
ACTCGTTGTGGGAACTCAATGTGCCCCGCCGCGACCTGCGCATGCTCGCCGCGCGGCTAGGCAGCGATGTGCCGTTTGCC
CTGCATGGTGGTACCGCGCTGGGGACGGGTCGCGGCGAGGAGTTGGCCACCGTGTTATCCCGCAACACCTTCCACTGGGT
CCTGGCGTTCGCCGACAGCGGGTTGCTCACCTCCGCGGTGTACAACGAGCTCGACCGGCTCAGGGACGTGGGGGATCCGC
CCCGGCTTGGTGAGCCCGGGCCGGTTCTGGCTGCCTTAGCTGCGGGTGATCCGGATCAGCTGGCGCCGTTGCTGGGTAAT
GAAATGCAAGCGGCCGCGGTGAGCCTGGACCCGGCGCTGGCTCGTGCGTTACGCGCCGGTGTGGAGGCCGGCGCGCTCGC
AGGCATCGTGTCCGGTTCGGGTCCCACGTGTGCCTTCCTGTGCACCTCGGCCAGCTCGGCGATCGATGTCGGCGCGCAGC
TGTCGGGGCGGGAGTTTGTCGCACCGTTCGAGTCGCCACCGGGCCGGTACCCGGCGCCCGCGTGGTGTCTGCGCCGACC
GAAGTGTGACCGAATTCTTGGGAGCATGCCTCGGGCGGCCAGGGGTATCCGCGCGTGCCGAGGCCGGTGGGTCGATCGGC
TGGCGCACCAGCATGCCAGCGGTAGGGCCGCAGGCATCCGCCCTCGCGAGGTCGGTGGCGCGCATCAAAGCCAGGCGCAA
AAGCCATACCATGATGCGACAGAGCCGCTCGGCGAGAGCCTCCGCTACCGGCCAGCTCACGGCGATAGCTGCATCAACGG
CCATCGAGACAACCCGTCGGCACGGGAATCCTCGCAGTTCACCGCGGGGAGTACGGCAAAGGCTGTGACCAAGCTGTGAC
ATCGCCCTCAAACCTCGGCAGAGTTTGGCAGCTACTTAAGAGTTGCTTAAGATAATCCGCGGTGTTGGGTCGTGGGCTCA
TCACCGAACCGAGACCCAACCGCTCCCCAACTGTGTGCGCGCGCCTGTCGCGATGTGGCATCCGGTAGGCGGACCATGAA
AACCCGGACCTTGGGGACGACACCGGAGGCGAGGAGGTTGCCTTGAGCAGGTTCACCGAGAAGATGTTCCACAATGCCCG
CACCGCGACGACGGGCATGGTCACAGGTGAACCGCACATGCCCGTCCGCCACACCTGGGGCGAGGTCCATGAGCGTGCTC
GTTGCATCGCGGGCGGCCTGGCCGCCGCGGGTGTCGGTCTTGGTGACGTTGTTGGGGTGCTGGCCGGCTTCCCGGTGGAG
ATCGCCCCACGGCGCAGGCCCTGTGGATGCGCGGGGCCAGCCTGACCATGCTGCACCAGCCCACACCGCGCACCGACTT
GGCCGTGTGGGCCGAGGACACCATGACCGTCATCGGCATGATCGAGGCCAAGGCCGTGATCGTCTCCGAGCCCTTCCTCG
TGGCCATTCCCATCCTTGAGCAGAAAGGCATGCAGGTCCTTACCGTCGCTGACCTTTTGGCGTCGGATCCGATCGGCCCC
ATCGAGGTCGGCGAGGACGACCTGGCGTTGATCAGCTGACGTCCGGATCTACCGGCTCCCCTAAAGCCGTCCAGATCAC
CCACCGCAACATCTACTCCAACGCCGAGGCAATGTTCGTCGGCGCCCAGTATGACGTCGACAAGGACGTCATGGTCAGCT
GGTTGCCCTGCTTCCATGACATGGGCATGGTGGGCTTCTTGACTATCCCGATGTTCTTCGGTGCGGAGCTGGTCAAGGTC
ACGCCAATGGACTTCCTGCGCGACACGCTGCTGTGGGCGAAGCTCATCGACAAGTACCAGGGCACCATGACCGCGGCGCC
CAACTTCGCCTACGCGCTGCTCGCCAAGCGGTTGCGGCGCCAGGCCAAGCCCGGCGACTTCGATCTGTCGACCCTACGCT
TCGCGCTGTCCGGCGCCGAGCCCGTCGAACCCGCCGACGTCGAGGACCTGCTCGACGCGGGCAAGCCGTTCGGCCTGAGG
CCCTCAGCCGATCCTGCCGGCCTACGGCATGGCCGAGACCCACGCTGGCGGTGTCCTTCTGGGAGTGCAACGCGGCCTCGT
CGTGGACGAGGTTGACGCCGACCTGCTGGCGCTCTGCGCCGGGCCGTTCCCGCCACCAAAGGCAATACCCGCAGGCTGG
CCACGCTAGGTCCGCTGCTGCAGGACCTAGAGGCCCGCATCATCGACGAACAGGGCGATGTCATGCCCGCCCGCGGCGTG
GGTGTCATCGAGCTGCGCGGCGAGTCGCTAACTCCCGGCTACCTGACTATGGGTGGCTTCATCCCGGCCCAAGACGAGCA
TGGCTGGTACGACACGGGCGACCTCGGCTACCTCACCGAGGAGGGCCACGTGGTGGTATGTGGCCGCGTCAAGGATGTCA
TCATCATGGCCGGGCGCAATATTTACCCGACCGACATCGAGCGGGCGGCCGGCCGCGTCGACGGCGTTCGTCCGGGTTGC
GCGGTGGCCGTGCGTCTCGATGCCGGACATTCGCGCGAATCCTTTGCCGTCGCGGTCGAGTCGAACGCCTTCGAGGATCC
CGCCGAGGTTCGTCGCATCGAGCATCAAGTGGCCCACGAGGTGGTTGCCGAGGTCGACGTGCGGCCTCGCAACGTCGTGG
TTCTTGGACCCGGGACCATTCCGAAGACGCCGTCGGGCAAGCTGCGTCGGGCCAACTCCGTCACCCTGGTCACCTAAGGC
CGCCGAGCAGACGCAAAATCCCCTCGACACGCCGGTTGCGAGGGGATTTTGCGTCTGCTCACGCGGGTCGTTACCAGGCG
TGGACGCGGTTTTGTGCGGGCTCCATGCCCTGTTCGATAAGCAGCTCGGTGGCATCGGCGGCCTGCTCGCAGATCGTGGG
GACCTCGGCGCGCTCGGCCGGGGTAAAGTTCTCCAACACAAACGCCGCCGGGTCCTTGCGGCCGGGCGGGCGGCCGATCC
CGATACGCACCCGCTGAAAGTCTTTGGTACCCAGCGCGGCCACCACCGAGCGCAACCCGTTGTGGCCGCCTTCGCCGCCG
```

FIGURE 8(continued)

```
CCGATCTTGAGCCGGATGCGGCCGAACTCGAGGTCAAGGTCGTCGTGGATGACGATGATGTTGGCCGGCGCCACCGAGTA
GAACTTCGCCAGCGGCCCTATCTGGCGGCCGGACTCGTTCATGTAGCAGCGCGGCTTGGCCAAAACCAGGGAGCGCCCGG
CTGATCTACCAGTGGCGACTTCGGCGCCGGAACGCTTGTGTGCCTTGAACTTCGCGCCTAGTCGCGCGGCGAGCAGATCG
GCGACCACGAACCCGAGGTTGTGCCGGGTACGGGCGTAATTGGCTCCAGGGTTGCCGAGGCCGACCACGAGCAACGGCTC
GGCCATGTCGCAAGCCGTCTACTCGGACTCGCCAGCGGCCTCGGCTTCGCGGCTTCTACCGCGGCTTCCTCGGCTTCCT
CGGCTCCTGCGACTTCGCCCTCCAGCTCCTCGGCGGTTGGCGCCTTCACCACGTTGACCACCAACAGATCAGGGTCAGAA
ATCAGGCTGACACCGGCCGGCAGCGCGATCTGCCCGGCGGTGAGCTGGGTGCCTGGTTCGGCACCTTCGATGGACACGGT
CAACTGCTCGGGAATCGACAGCGCCTCGGCCTCGATCTCGATGCTGTTGGTCTCTTGGGTGACCAGGGTGTCGGGTCCGG
CCTGGCCCTCGACGACCACGCTGACTTCGACGACGACCTTCTCGCCACGGCGCACGACCAGTAGGTCGGCATGCTGGATG
GTGCGGCGGATCGGATGGATATGAAGTGCCTTGGTCAGTGCCAGCTGTTCCTTACCGGCGATGTCGAGGGTCAACACCGC
GTTGGTGCCGGAATGCCGCAGTACGGCCGCATAGTCGTGTCCGGGCAGCTCCAGGTGCTGTGGCTCGGCGCCGTGGCCAT
ACAGCACAGCGGGTATCTTGCCGGCGCGCCGGGCCCGCCGGGACGCGCCCTTGCCGGTCTCGGTACGCACCGTGACGCGC
AGCTGGTTGCTTGCGGATTTGGCCATATGTCGCTCCTGGGTGGCTCGGTTACCTCGTTTGGGGGCACGGCCAGGGTCGCG
ACAGCTTGTCGGCCTCCGTCGATAACGGTGTTCTGCCGGCCTGCTGTAGACCGCCGACCACCCTCGCCGTGACGCCCGGC
TAGGCTAACCCATGGCTACTGCATTGGGGAAATTCGATCCTTGTGAGCTGCTCGGATAGCTGTGCCCCAACCGTGCGGAC
AATTACTTTGCCGCGACGACGAATCCGGCGATGATCGCCTCGATGTCGGAAGCGTGCTTGACGGCCTCGTTGGCCAGACT
CGTGATGGTGAGCTGCACCAGGTAGCGCTGCTTGGCCGGCGGTGCGCCGGTTGGGAAGACGATCCGGTTCCAGGTGTGCA
GTCGCCTGCCGTGCAGGTCATAACTGCCCTGAATCATCGAGGACGGAAACCCGTTGAAGTCTGCCGTCGAGGAGTCCAAT
TCGGTGAAGTTCGTCGACAGCCGGGCATCGGCAGTGCCATGCTTGAGCGCTTCGGCGATATCGAAGTCCCGGTGCAGCTT
GAACACCATGAGCATGGCCGTTGGATAGCTTTCGCCCTTGGCGATCATCTCCGTGTTCGGGGTGATGTTCGGATTTTTCA
TCGGTGCCCAGCCCGGTGGTGTCGGAATCGACACGGTCAGGTCGGTCAGGCTGCTCGGTGCCACCGGCTCTCCGGTGACG
CCGACGCTTTCCAGATACTTCCACAGCGGGACCGGCACTTCCGTCGTGGTCGAGACGGCGCTGGTGGTTGGGCTCGTGGA
CAAAATCGACTGGAAGTCAGGCGATTTCGGTCCGCAAGCGACCGCTGACATTGCCAGCGTGGCTACCGCGACCGCGACCG
CCAAGGGTCTCACAGAATCTTGCGGACAGCGTCGACCGGCCAAGCCCGCCGGATGCCCTCAAGGATGACGGCTGCCATCT
ATGCGTCCCCGTCGAAAAGTCCTGTTACTGAGCCGTTTTCGAAGACCGCCCGGATTGTGCTGGCCAGCAGCGGCGCGATG
GACAAAACGGTGAGCTGGGGGAAGCGCTTGTCTTCGCCGATCGGGAGCGTGTTCGTGACGATCACTTCGCGGGCGCCGCA
GGAGGCCAGCCGCTGCGCAGCGGGGTCGGAGAGCACGCCGTGGGTTGCCGCGATGATCACGTCACCGGCGCCGTCGTTGT
GCAGCAATGCCACCGCGCCGGCGATGGTGCCGCCGGTGTCGATCATGTCGTCAATCAGGACACAGGTGCGCCCGGCCACG
TCGCCGACGACGCGGTTGGACACCCACTTGGTTGGGTACCCGCGGCATCACGGGTCTTGTGGATGAAGGCGAGGGGAACACC
ACCTAATGCGTCGGCCCACTTCTCGGCGATGCGTACCCGGCCGGAGTCAGGGGAGACGACCACCATGTTGCCGTCCGGGT
AGTTGTCTCTGATGTAACCGGTCAGCAGGTTCTGACCGCGCATATGATCGACCGGCCCGTCGAAGAAACCCTGGATCTGG
TCGGTGTGCAGGTCGACCGTCACGATCCGGTCGGCGCCCGCGGTCTTGAGCAGGTCGGCGATCAGTCGCGCGGAGATCGG
TTCGCGGCCACGGTGTTTCTTGTCTTGCCGGGCATACGGATAGAACGGCATGACGGCGGTGATCCGTTTGGCGCTGCCCC
GTTTGAGCGCGTCGATCATGATCAGCTGCTGTTCCATCAGCCACCTGTTCACCGGTGCCGGGCAGGATTGCAGGACGAAGGCG
TCGAACCGCGTACCGATTCGTGGAAGCGCACGAAGATCTCGCCGTTGGCGAACTCCCGCGCGTCCTGAGAGGTGACGTG
GACGTCGAGCTCTTTGGCTACCTGCTCGGCCAGCTCCGGATGGGCGCGGCCGGCAAAGAGCATCAGGTTTTGCGATTAT
CGGTCCAGTCGTGGCTCAACGCGCTGCCCTCGCCGTTTGGGATCGAATTGGATTACCCATGGTACGTAGCGCACCGCCCG
GATTTGTCGCCGGGTAGCCGGGATGCGACTTCACGGTGTCTGATCAGCGTCGGTGGTTGTGTGGGCTGTTGGCAGGCCA
TTTCTGAGGCTCTTTTTGAGGCCTGAGCCGCTGGGCTGCCGGGGCGTTTGCGCTGCACCCAGTTCTCGATGTTGCGTTGC
GGACCCGCCGACACTGCCAGCGCCCCCGGCGGGACATCCTCCCGCACCACTGTGCCGGCCCCGGTATACGCGCCGTCGCC
GATGGTTACTGGGGCCACGAACATGGTGTCGGACCCGGTCCGTACGTGCGAACCGACGGTGGTGCGCCGTTTGGACGTAC
CGTCGTAGTTGACGAACACGCTGGAGGCGCCGATGTTGCTGCCGATGTCGCCGACGTAGGTCAGGTGC
GGCACCTTGGTGCCGGTGCCGATGGTGGAGTTCTTGACCTCGACGAACGCGCCCAGCTTGCGTCGGCGCCCAACGCGGT
TCCGGGCCGCAGGTAGGTGAAGGGCCCGACCGCGGCGCCATCCCCAATCGACGACGACGAACCGTGGGTGCGCACCACCG
AGGCACCGTCGCCGACGGCGACGTCGGTCAGGGTGGTGTCGGGACCGACGACACAGCGACCGCCGATCTGGGTGCGGCCC
AGCAACTGGGTACCCGGGTGAATGACGGTGTCGCGGCCGATGGTGACGTCGACGTCGATCCAGGTGGTAGCCGGGTCGAC
GACGGTGACGCCGGCCACCTGGTGAGCGGCCACCACCCGCCGGTTGAGTTCGGAGGCCAGCTCGGCCAGCTGGACGCGAT
TGTTGACGCCGGCCACCAACGCGCTGTCGTCGACGTGGCTGGCATGTACGGTCTGGCCGTCGGAGCGCAAGATGGCGATG
ACGTCGGTGAGGTAGAGCTCCTGTTGGGCGTTGTTGGAGCTCAGCCGGCTCAGTGCGGACCGCAGCGCGGCGATGTCGAA
GGCGTAGACGCCGGCGTTGACTTCGCGGATTTCCCGCTGCGATGGTGTCGCGTCGGTTTGCTCCACGATCGCCATGACTT
CGTGATCCTGGGTGCGCAGGATGCGGCCGTAGCCGAAGGGATCATCCAGCGTCGTGGTCAGCACCGTCACCGCAGCCGAC
ACCGCGCGGTGGGTGGCGATCAAGTCGGCCAGCGTGTCGGCGTCCAGCAGCGGGTATCTCCGAGGTGACCACGACGTT
GCCGGCGTAGTCATCGGGCAGCGCGGACAGCCCGCAGAGTACCGCATGCCCGGTCCCTAGCGGTCGATCCTGCAGGGCGA
CGTCGATCGTTCGGCCTAGGGTGTCGGCGAGTTCACCGACTAGCGGCGCGATGCGCTGGTGATCGTGTCCCAGCACCACG
ATTAGACGCTGCGGCGCCAGCTTGGCGATCGCATGCAGTACATGCGACAGCATGCTGCGACCGGCGAGTGTGTGCAGCAC
CTTGGGGGTGTCCGAACGCATCCGGGTCCCGGGCCCGGCCGCTAGGACCAGGACCGCGGTGTCACCAGGAAACGTCATCA
```

FIGURE 8(continued)

```
ACCCTCCTTGAAGCTCCGTCGCCAGGACTCGAACCTGAACTATCTGAACCAAAATCAGAGGTGCTGCCGATTACACCACG
ACGGATTGCACATCGATGTGACTTTAGACGGTGTCAACGCCGTCAGCACAGTCAACGCTGTCGCCGTCTACCCACCGGCC
CCACGCAAACCGATACCCTTGTTGATGTGGCCGGACCGGATAAAGGGCCGGATAAGGCGCCGGAAAACCCGACGCGGGTG
ACGCGCGCCAGGATGACGGGGACCGAGCGCCGTCACCAGCTCATCGGCATCGCGCGATCGCTGTTTGCCGAACGCGGTTA
CGACGGGACGTCGATCGAAGAGATCGCGCAGCGCGCCAACGTATCCAAGCCGGTCGTCTACGAACATTTCGGTGGCAAGG
AGGGCCTGTACGCGGTGGTGGTCGATCGGGAGATGTCGGCGCTGCTGGACGGAATCACCTCGTCGCTGACCAACAACCGA
TCCCGGGTGCGGGTGGAGCGGGTCGCGCTGGCGTTGCTGACCTACGTCGAGGAACGCACCGACGGCTTCCGCATCATGAT
TCGCGACTCGCCGGCCTCGATCAGCTCGGGCACCTATTCCAGCCTGCTCAACGACGCCGTCAGCCAGGTCAGCTCGATTC
TGGCTGGAGACTTCGCCCGGCGCGGCCTGGACCCGGACCTGGCACCGCTGTATGCGCAAGCATTGGTGGGTTCGGTGTCG
ATGACGGCGCAATGGTGGCTCGATGCGCGCGAACCGAAGAAGGAAGTGGTGGCCGCGCACCTGGTCAACCTGGTCTGGAA
TGGCCTGACCCACCTGGAGGCCGATCCGCGGCTACAGGACGAGTAGCGGGCGGGGAAGCCGGGCCCAATGTTGACTAACC
TCGGCGCCCTAGAATGGCCGCATCATGACCGCACCGGGGCCTGCCTGCTCAGATACCCCGATCGCGGGGCTCGTCGAATT
GGCGCTGAGCGCGCCGACATTCCAACAGCTCATGCAGCGCGCCGGGGGTCGACCCGACGAATTGACGCTCATCGCGCCGG
CCAGCGCGCGGCTGTTGGTCGCCAGTGCGCTGGCTCGGCAGGGGCCATTGCTGGTGGTCACCGCCACCGGGCGGGAAGCC
GACGACCTGGCCGCCGAACTGCGTGGTGTGTTCGGGGATGCGGTGGCGTTGTTGCCGTCCTGGGAGACACTGCCGCACGA
ACGGCTCTCACCCGGTGTTGACACCGTCGGCACTCGCCTGATGGCGCTGCGCCGGCTGGCCCACCCCGACGATGCCCAGC
TGGGCCCACCGCTGGGGGTAGTGGTGACCTCGGTGCGCTCGCTGCTGCAGCCCATGACGCCGCAGCTGGGCATGATGGAG
CCCCTCACGCTGACCGTTGGCGACGAATCCCCCTTCGACGGCGTGGTGGCGCGGCTGGTCGAGCTGGCATATACCCGGGT
GGATATGGTCGGCCGGCGCGGCGAGTTCGCTGTGCGCGGCGGGATTCTGGACATCTTTGCCCCGACGGCCGAACATCCGG
TGCGGGTCGAGTTCTGGGGCGACGAGATCACCGAGATGCGGATGTTCTCGGTAGCCGACCAGCGCTCGATTCCGGAGATC
GACATTCACACACTGGTTGCCTTCGCCTGCCGTGAACTGCTGCTGAGCGAGGACGTGCGGGCGCGGGCCGCCCAACTGGC
CGCACGGCATCCCGCGGCCGAGAGCACCGTCACCGGCAGTGCTTCCGACATGCTGGCGAAGCTCGCCGAGGGCATCGCGG
TCGACGGCATGGAGGCGGTGTTGCCGGTGCTCTGGTCCGACGGGCACGCGTTGCTGACCGATCAGCTGCCCGACGGCACG
CCGGTGTTGGTGTGCGACCCGGAAAAGGTGCGCACCCGCGCCGCGGATCTGATCAGGACTGGCCGTGAATTCCTGGAAGC
CTCGTGGTCGGTCGCGGCGCTGGGAACTGCAGAAAATCAAGCCCCGTCGACGTCGAACAACTGGGTGGGTCGGGGTTCG
TCGAACTGGACCAGGTGCGGGCCGCGGCGGCCCGAACGGGTCATCCGTGGTGGACGTTGAGCCAATTGTCCGACGAGTCG
GCGATCGAGTTGGACGTTCGGGCCGCGCCGTCGGCGCGCGGGCACCAGCGTGACATCGACGAAATCTTCGCGATGCTACG
TGCCCACATCGCGACCGGCGGGTACGCCGCGCTGGTCGCGCCGGGCACCGGAACCGCACACCGCGTGGTCGAACGGCTGT
CCGAGTCCGACACCCCCGCGGGGATGCTCGATCCCGGCCAGGCGCCCAAGCCGGGAGTCGTCGGGGTGCTCCAGGGCCCG
CTGCGTGACGGCGTCATCATTCCCGGCGCCAACCTGGTCGTCATCACCGAGACCGATTTGACCGGCAGCCGGGTCAGCGC
CGCCGAGGGCAAGCGGCTGGCGGCCAAGCGGCGCAACATCGTCGACCCGCTGGCGCTGACGGCCGGTGACCTGGTGGTGC
ACGATCAGCACGGCATCGGCCGGTTCGTGGAGATGGTCGAGCGCACGGTCGGGGGCGCCCGCCGGGAGTATCTGGTGCTG
GAGTATGCCTCGGCCAAGAGGGGTGGCGGGGCGAAAAATACTGACAAGCTCTATGTCCCGATGGATTCGCTGGACCAGCT
GTCGCGGTATGTCGGCGGGCAGGCGCCGGCGCTGAGCCGGCTGGGCGGCAGCGACTGGGCCAACACCAAGACCAAGGCGC
GCCGCGCGGTGCGCGAGATCGCGGGCGAGCTGGTCTCGCTGTACGCCAAACGGCAGGCCAGCCCCGGGCATGCGTTCTCG
CCGGACACGCCGTGGCAGGCCGAGCTGGAGGACGCGTTCGGCTTCACCGAGACCGTGGACCAGCTCACCGCCATCGAAGA
GGTCAAGGCGGACATGGAAAAGCCGATCCCGATGGACCGGGTGATCTGCGGCGATGTCGGCTACGGCAAGACCGAGATCG
CGGTGCGGGCGGCGTTCAAGGCGGTCCAAGACGGTAAACAGGTCGCGGTGCTGGTGCCCACCACGCTGCTGGCCGACCAG
CATCTGCAGACGTTCGGCGAGCGAATGTCCGGATTCCCGGTGACCATCAAGGGTCTGTCGCGGTTCACCGACGCCGCCGA
GTCCGCGCCGTGATCGACGGCCTGGCCGACGGGTCGGTGGACATCGTGATCGGCACCCATCGGCTGCTGCAGACCGGGG
TGCGCTGGAAGGATCTGGGCCTGGTGGTGGTCGACGAGGAGCAGCGGTTCGGCGTCGAGCACAAGGAGCACATCAAGTCA
CTGCGCACCCATGTCGACGTGCTGACCATGAGCGCCACCCCGATCCCGCGCACGTGGAGATGAGCCTGGCCGGGATTCG
CGAGATGTCGACCATCCTGACGCCGCCCGAGGAGCGCTACCCGGTGCTGACCTACGTCGGACCGCACGACGACAAGCAGA
TCGCCGCGGCGCTGCGCGGGAGCTGCTGCGCGACGGGCAGGCGTTCTACGTGCACAACCGGGTCAGCTCGATCGACGCG
GCCGCCGCCCGGGTGCGTGAGCTGGTGCCCGAGGCGCGGGTGGTGGTCGCGCACGGGCAGATGCCCGAGGACCTGTTGGA
GACCACCGTGCAACCGGTTCTGGAACCGCGAGCATGACATCCTGGTTTGCACCACCATCGTGGAGACCGGCCTGGACATCT
CCAACGCCAACACTTTGATCGTCGAGCGCGCCGATACCTTCGGGCTGTCCCAGCTGCACCAGCTGCGTGGCCGGGTGGGC
CGCAGCCGGGAGCGCGGCTACGCCTATTTCCTCTATCCACCGCAGGTGCCGCTGACCGAGACCGCTTACGACCGGTTGGC
GACGATCGCGCAGAACAATGAGCTGGGCGCGGGCATGGCCGTGGCGTTGAAGGACCTAGAGATCCGCGGTGCCGGCAACG
TGCTCGGCATCGAGCAGTCCGGACACGTCGCCGGCGTCGGATTCGACCTGTACGTGCGGTTGGTCGGCGAGGCCCTGGAG
ACGTACCGGGACGCGTACCGGGCGGCCGCCGACGGCCAAACCGTGAGGACCGCCGAAGAACCCAAGGATGTGCGAATCGA
CCTGCCCGTTGACGCGCACCTGCCACCGGACTACATCGCCAGTGATCGGCTGCGGCTGGAGGGCTACCGGCGGCTGGCGG
CCGCCTCCTCTGATCGCGAAGTGGCGGCCGTTGTGGACGAGCTAACCGATCGGTATGGGGCCCTGCCGGAGCCGGCCCGG
CGGCTGGCGGCGGTGGCACGGCTGCGGCTGCGTGTGCCGTGGCTCCGGCATCACCGACGTGACGGCGGCGTCGGCAGCGAC
CGTGCGGCTGTCCCCGTTGACGCTGCCGGACTCCGCCCAGGTGCGGCTGAAGCGAATGTATCCCGGAGCGCACTACCGTG
CCACGACGGCCACCGTGCAGGTTCCCATTCCGCGAGCCGGTGGCCTCGGCGCGCCGCGAATCCGCGACGTCGAGCTGGTT
```

FIGURE 8(continued)

```
CAGATGGTGGCCGATTTGATAACCGCGCTCGCTGGGAAACCGCGCCAGCATATTGGTATAACGAACCCTAGCCCGCCAGG
CGAAGACGGCCGTGGTCGCAACACGACGATTAAGGAGCGACAACCGTGATGATTGTCGTCCTGGTCGACCCCCGGCGTCC
GACACTGGTGCCTGTTGAAGCGATCGAGTTCCTGCGCGGCGAGGTGCAATACACCGAGGAAATGCCGGTCGCGGTGCCCT
GGTCGCTACCAGCGGCTCGTTCGGCGCACGCCGGAAACGACGCGCCGGTGTTGCTGTCGTCTGACCCCAACCATCCTGCT
GTCATTACTCGACTGGCCGCCGGTGCCCGGCTGATCTCGGCACCGGATTCTCAGCGTGGCGAACGACTCGTCGACGCCGT
CGCGATGATGGACAAGCTGCGCACCGCCGGACCGTGGGAAAGTGAGCAGACTCACGACTCGCTGCGCAGATACCTGCTGG
AGGAGACCTACGAGCTGTTGGACGCGGTCCGCAGCGGCAGTGTTGACCAGCTGCGCGAAGAGCTTGGTGATCTCTTGCTG
CAGGTCCTCTTTCACGCCCGGATCGCTGAGGATGCGTCGCAATCGCCGTTCACCATCGACGACGTCGCCGACACACTGAT
GCGAAAGCTCGGCAATCGGGCGCCAGGAGTACTTGCGGGCGAATCGATTTCGCTCGAAGATCAACTGGCGCAATGGGAGG
CAGCCAAGGCCTCGGAAAAGGCGCGAAAGTCGGTAGCCGACGATGTCCATACGGGCCAGCCGGCATTAGCGCTGGCGCAG
AAGGTTATTCAGCGTGCCCAAAAGGCTGGGCTGCCCGCTCACCTGATCCCCGATGAGATCACTTCTGTTTCGGTTTCAGC
TGACGTAGATGCGGAAAACACGCTGCGCACTGCCGTTTTGGACTTTATTGACAGGCTGCGCTGTGCCGAGCGGGCAATTG
CCGTCGCACGCCGGGGCAGCAACGTTGCCGAGCAGCTCGATGTGACGCCGCTGGGTGTGATCACCGAGCAGGAGTGGCTC
GCGCATTGGCCAACTGCTGTCAACGATTCCCGCGGCGGGTCCAAGAAACGTAAAGGCATGCGATAACCGCCCCGAGTGCG
ACGGGGTAGTCAACAAACCCATGGGACGATGATCGTGACGGAAGCCGGTATAGGTGCCCTACGAGGGAGAGTTGTGTCGC
CGAGACGCTGGTTGCGGGCGGTCGCCGTGATAGGGGCGACCGCGATGCTGTTGGCGTCGAGCTGCACTTGGCAGCTGAGC
CTTTTCATCACCGACGGCGTGCCGCCTCCGCCCGGCGATCCGGTGCCGCCGGTGGATACGCACGCCGGCGGCCGGCCCGC
GGATCAGTTGCGCGAATGGGCGGAGAAACGTGCTGCGGCATTGGGAATTCCGGTCATCGCGCTGGAGGCCTACGCCTACG
CCGCTCGCGTCGCCGAGGTCGAGAATCCCAAGTGTCATCTTGCGTGGACCACGCTGGCGGGCATCGGGCGGGTGGAGAGT
CACCACGGAACCTACCGGGGCGCCACGATTGCGCCCAATGGGGATGTAAGCCCCCCGATTCGGGGCGTCCGCCTCGACGG
CACCGGCGGCACCCTGCGCATCGTGGACAGGGACGGGGGCGACCGCTGGACGGTGACGCCGCGGTGGAGCGTGCGATGGGGC
CAATGCAGTTCATTTCGGAAACCTGGCGGTTGTACGGGGTCGCTGCCAGAAACGACGGCATCGCCAACGTCGACAACATC
GATGATGCTGCCCTCTCGGCAGCGGGCTATTTATGCTGGCGTGGAAAGGATCTCGCGACACCGCGAGGGTGGATAACCGC
GCTGAGGGCCTACAACAACTCCGTTATCTATGCGCGGGCGGTCCGGGACTGGGCGACCGCGTATGCGGCGGGTCATCCGC
TGTAGCAGGATGAACCGCTAACCCAGGCTTTACGCTAACAGCGGTCGGGGCCAGCCAACCCAAGACCGTCCGTGCAGCAG
CTACGACGCAAGGAGAACCCAGTGCCGATTATCGAGCAGGTTAGGGCCCGAGAGATCCTCGATTCCCGCGGCAACCCGAC
GGTGGAGGTCGAGGTGGCGCTTATCGACGGGACATTCGCCCGGCCGCGGTGCCGTCGGGCGCCTCGACCGGGGAGCACG
AGGCCGTCGAGTTGCGCGACGGCGGCGATCGCTACGGCGGCAAAGGCGTGCAAAAGCCGTGCAGGCTGTTCTTGATGAG
ATCGGCCCGGCCGTCATCGGACTCAACGCCGACGACCAGCGATTGGTCGACCAGGCGCTGGTGGACCTAGACGGCACCCC
CGACAAGTCCCGGCTGGGCGGCAACGCGATCTTGGGTGTCTCGCTCGCTGTTGCCAAGGCGGCGGCGGATTCGGCGGAGC
TGCCGTTGTTCCGTTATGTCGGGGGGCCAAACGCGCACATTCTGCCGGTACCGATGATGAACATCCTCAACGGCGGCGCA
CACGCCGATACCGCTGTCGACATTCAAGAGTTCATGGTGGCGCCAATTGGCGCGCCCAGCTTCGTCGAGGCGTTGCGCTG
GGGCGCTGAGGTGTACCACCGCGCTCAAGTCGGTCCTGAAAAAGGAGGGGCTGTCCACCGGCCTGGGCGACGAAGGCGGCT
TCGCCCCGGATGTGGCCGGCACCACCGCGGCGTTGGACCTGATCAGCCGGGCCATCGAGTCGGCGGGCTTGCGACCCGGC
GCCGACGTGGCGCTGGCCCTGGACGCGGCGGCCACCGAGTTCTTCACCGACGGCACCGGCTACGTCTTCGAGGGCACCAC
CCGTACCGCAGACCAGATGACCGAGTTCTACGCGGGCCTGCTCGGCGCCTACCCGCTGGTGTCGATCGAAGACCCACTGT
CCGAAGACGATTGGGACGGCTGGGCCGCGCTGACGGCCTCGATCGGTGACCGGGTGCAAATCGTCGGCGACGACATCTTT
GTCACCAATCCCGAGCGGCTCGAGGAGGGCATCGAACGGGGCGTGGCAAATGCGTTGCTGGTCAAGGTGAACCAGATCGG
GACGTTGACCGAGACACTCGACGCGGTCACGCTGGCTCACCACGGCGGATACCGCACGATGATCAGTCACCGCAGTGGCG
AGACGGAGGACACCATGATCGCCGACCTCGCGGTGGCCATCGGCAGCGGCAGATCAAGACGGGCGCGCCTGCTCGCAGT
GAGCGCGTCGCAAAATACAACCAGCTGCTGCGGATCGAAGAGGCGCTTGGCGACGCGGCCCGCTACGCGGGCGACCTGGC
ATTTCCTCGGTTCGCGTGCGAGACGAAATAGGTACATGCCCGAAGCGAAACGGCCCGAATCGAAGCGCCGGTCGCCGGCA
TCGCGCCCGGGAAGGCCGGCGACTCGGTTCGGGGCGGTCGCGCCACCAAGCCTTCCGCAAAACCCTCCACGCCCGCACC
GCACGCCAGCCGCAAGACCACTCGCACGCCGCATGAGCACATTGTCGAACCCATCAAACGGGCGATCACCGAATCGGTCG
AGAAGCGCTCCGAACAGCGGCTGGGGTTCACCGCGCGGCGCGCAGCGATCCTCGCCGCGGTTGTATGCGTGCTGACGCTG
ACCATTGCGAGGCCGGTACGCACCTACTTCGCGCAGCGCGCGAGATGGAACAACTGGCTGCGACCGAGGCCATGTTGCG
CCGCCAGATCGCTGACCTGGAGGAACAGCAGGTTAAGCTCGCCGATCCGGCGTATATTGCGGCTCAGGCCCGCGAACGGC
TCGGCTTTGTGATGCCTGGAGACATCCCGTTTCAGGTCCAGCTTCCGTCGACGCCGTTGGCGCCGCCGCAACCGGGGTCA
GACGCGGCTACTGCGACCAACAACGAACCCTGGTACACCGCGCTGTGGCACACGATCGCCGACGACCCGCACCTGCCGCC
TGCCGCGCCACCGGCACCGGAGCCCGGACGTCCGGGCCCGCTGCCGCCGGCCTCGCCAAACCCGAGCAGCCCGGTGGTT
GATCGTGCCGATCTGGAGGTGGTCACGCGGCAACTCGGCCGTGCACCCCGGGGTGCTCGCGATCGCCTATCGTTGCCC
CAACGGTGAACCCGGCGTCGTGAAAACTGCGCCGAGACTGCCCGACGGCACGCCGTTTCCGACCCTGTACTACCTGACGC
ATCCGGTGCTCACGGCGGCGGCCAGCAGGTTGGAGACCACGGGACTCATGCGCGAGATGAACCGGCGGCTGGGCCAGGAT
GCGGAGTTGGCCGCCGCCTATCGACGGGCACACGAGTCGTATCTGTCCGAGCGTGACGCTCTCGAGCCGCTCGGGACAAC
GGTCTCCGCGGGGGGCATGCCCGACCGGGTCAAGTGCCTGCATGTGCTGATCGCGCATTCGCTGGCCAAGGGCCCGGGGT
TGAACCCATTCGGTGACGAGGCGCTGGCGTTACTGGCCGCCGAGCCACGGACGGCCGCGACCCTGGTGGCTGGGCAGTGG
```

FIGURE 8(continued)

```
CGCTAACCCGGGTCGCCGCGATCGACTGCGGTACCAACTCGATTCGCTTGCTGATCGCCGACGTGGGAGCCGGGTTGGCG
CGCGGAGAGCTGCACGATGTGCATCGTGAGACCCGGATAGTGCGCCTGGGCCAGGGAGTCGACGCCACCGGTCGGTTCGC
GCCGGAGGCGATTGCGCGGACCCGGACCGCCCTGACCGACTACGCCGAACTGCTGACGTTTCACCATGCCGAGCGGGTGC
GGATGGTCGCCACGTCGGCCGCCCGCGATGTGGTCAATCGCGACGTTTTCTTTGCGATGACGGCCGACGTGTTGGGCGCC
GCGCTGCCCGGCTCGGCCGCGGAGGTGATTACCGGCGCCGAGGAGGCCGAGCTCTCCTTCCGTGGAGCGGTGGGCGAATT
AGGCAGCGCCGGTGCGCCTTTCGTCGTCGTGGACCTCGGTGGCGGTTCCACCGAGATCGTGCTGGGCGAGCACGAAGTGG
TTGCCAGCTACTCGGCGGACATCGGATGCGTCCGGCTGACCGAACGCTGTTTGCACTCCGACCCGCCGACGTTGCAGGAG
GTGTCCACGGCCCGCCGGCTGGTTCGCGAGCGGCTCGAGCCCGCACTGCGCACCGTGCCGCTGGAGCTGGCCCGGACCTG
GGTCGGGCTGGCTGGAACGATGACCACACTGTCCGCGCTGGCGCAGTCCATGACGGCGTATGACGCTGCGGCCATTCATC
TTTCGCGGGTGCCCGGTGCTGATCTGCTCGAGGTTTGCCAGCGGCTGATCGGCATGACTCGCAAGCAGCGGGCCGCGCTG
GCGCCGATGCACCCGGGCCGGGCCGACGTGATCGGCGGTGGCGCGATCGTGGTCGAAGAGTTGGCGCGCGAGCTGCGCGA
GCGGGCCGGCATCGACCAGCTGACCGTCAGCGAACACGACATCTTGGACGGCATCGCGTTGTCACTGGCCGGATAAGTCA
CATCTGCCACACGCGTATCTGCGCGGGGGGACACTCTTCTGCCCGCCTCGTAGCGACAACCTTGGCCGATGTCAGACCCG
CATGGGAATGTTCGGCCATGACCAGACAACTGCATGGAATTGAGCTTCGATACGTGCTCACCCTGCACCTGGCCGTCCAT
GGACCGGCGGCCATTACCGAAATGATCTAAGGCCTGGGCTGGCACGGCTTTGGAGTCCGGGGCAGGGCATCCAAGGTGGT
GTCGGAGGCACTGCGCTGGGAAATCGGACGGGGCCGAGTATACCGGCTCGGGCGCGGACGCTACGGGCCGGGGTACATCC
CGCGCTCCACCGAATACCGGATTCACCAACGCGTGTTGGCGTTGCGGGCATCCGCCAACGTGTCGCTGCGAGGCGGGCAA
AGTGTACATCCGCTCCCAGCGGAAACGCCTGTGGCAGATGTGATTTAGGCTTCGAAGCGGTAGCCCATCCCTGATTCGGT
CAGCAGATGTTTGGGGTGCGACGGGTCATCCTCCAATTTGCGCCGCAGCTGCGCCAGATACACCCGCAGGTAATGGGTTT
CAGTCGCATATGCCGGTCCCCACACTTCTTTGAGAAGCTCCCCGCGGCCGACCAACTTGCCGCGGTTGCGGGCCAGCATT
TCCAGCATGCCCCACTCGGTCGGCGTGAGATGCACTTCGGCACCGTCTTTGATGACCTTGCCGGCCAGATCGACGGT
GAATGAATCGGTTTCGATCACCGGCTGCTCCAACTCGGCGGCCGCGGTGTTACGCCGTACCGCTGCGCGCAGCCGAGCCA
GAAACTCGTCCATTCCAAACGGTTTCGTCACGTAATCGTCGGCGCCCGCATCGAGGGCCTGGACCTTGTCCGACGAATCG
GTACGCGCCGACAACACGATCACCGGTGCCGTCAACCAGCCACGCAGCCCGCCGAGCACGTCGATACCCGACATGTCCGG
CAGGCCGAGGTCGAGGATCACCACATCGGGCGGATGCTCAGCGGCGGCGCGCAGCGCACCCGCACCCGTCGAGGCGGTGA
TGACCTGGTAGCCACGCACGGTCAGGTTGATACGCAGCGCGCGCAGGATCTGGGGTTCGTCGTCAATCACCAAGACGAGG
GTCATGGGCGGTCCTCGGGAGCCGCCAGATCGATCACCACTGTGAGCCCGCCGCCCGGGGTATCGGTAGCCGAAATCGTG
CCGCCCATAGCCTCGACGAAGCCGCGTGCCACCGACATCCCCAGACCGACACCGGTGGTGTTGTCGTGATCCCCCGGCCG
CTGGAACGGGGCAAAGAGTTGCTCCTCGGTCCCGCGCGGGACCCCTGGGCCTCGTCGATGACATTAATCAGGACCCGCT
CACGCACCCGTCCCGCGTTGACCCGGACCACGCAGTCGGGCGCATATCGCAGCGCGTTGTCGATCAGGTTGGCTAGCACC
CGCTCCAGCAACCCGGCGTCGGCCATCGCCACGGCGTCTCCCACGTCGACCTTGACCCGGTCGATGCCGGATCGGTAAAA
ACCGGTGGCGCCCTTGCCGATGCTGACCAAGGCCCGTTGCACCGCTTCCTCCAGGTATGCCCGGCGCAGCTGGGGCGAA
TCACGCCGGCAGCCAACCGCGACGAATCGAGCAGGTTTGCGACCAGGGCGGTGAGTTGGTCGATGGACTCCTCGATGGTG
GCCAACAGCTCGGCGGTATCTCCGGGGGAGAAAGCGACGTCTTCGGTGCCGCAAGCTGGACACCGCCAACCTTGGCCGCCGC
CAGCGGGGTGCGCAGGTCGTGGCTGACCGCCGACAGCAGCGACGCGGCGCAGCTCATCGGCCCTAGCGATGGCCTCGGCCT
GGCCGGCCTCTTCCGCCAGCTCGCGCTGCTTCACCAGACCCGCGGCCTGTGTCGCGACCGCGGTCAGCACTCGGCGGTCG
CGGGCGGCCAACTTGCGGCCTGCCATCAGCATCCAAAACTCGTCGTCGCCGACTTCGATTGCGGTGTCGGCGGAGTCGAC
GTCCCGACACGGGTTTGTCCCGACGCACGCGACGGTTTCGCCTGTCGATGCGCCCTGCCGGACACGCAGCATGGTCACGG
CCCGTTGGGAATAACGTTTCGCGGACCCGCTGCAGCAGCGTGGCAAGGTCTGCGCCGCGCAACACCGAACCGGCAAACAGG
GCCAGCAACTCAGCGCTCCTGGGATGCGCGCCGAGCCTCACGGGTTCGGCTAGCCGCGCCGTCCACCAACACCGCCACCGC
AACGGCCATCGCCAACAACACGAATTCGGTTACTGCGGCGTCCGGTTCGGCGATGGTCCAGGTGTAGCGGGGCTCGGTCA
GAAAGTAGTTCAGCAGCATGCCCGACAGCAAGGCCGACAATGCGGCGGGGGCGACGCCGCCCAGCAACGCCACGATCAGC
ACGCCGATGAAGAACAACGCGCTCTCGCCGCCGATGCCCATGAATCGGTCGAGCCAGGCCACCGTGATGGCGCAGATCAC
CGAGGGCACCACCAGCGCGGCCAGCCACGACGCGATATGCCGCTCGCGCGGGGAGACCCGCGACCACCCGGAGGCCCGGC
TGGCCGCGGGATGGGTGACCATGTGAACGTCGATGCCGCCGGGCTCCTGGACGGTGCGGGCGCCGATCCCCTCGTCAAAC
AGGCGTGCCCATCGCGATCGCCGACGATGTGCGCAGCGAGCTGCGTGGCGTTCATCTCGCGGGCGAAGTCCAGCAGCGC
GGTGGGCACGTCGTCGCCGACCACGGTGTGCATGGTCGCACCGAGGCTTGTCGCCAGCTCGCGGACCCTGCCCAGCTGCG
GCGCGGACACCCCCGCCAGGCCGTCGCCACGGATAACGTGAACCACCATCAGCTCGGCGCTGGACTTCGACGCGATCCGC
GATGCCCGTCGCACCAACGTCTCCGACTCCGGGCCGCCGGTCACGGCGACGACGACGCGTTCCCGCGCCTCCCACGTGGC
GGTGATCTTTTTGTCTGCGCGGTACTTCTCCAGGGCCGCATCAACTTGGTCGGCCAGCCACAGCAACGCGATCTCGCGCA
GCGCGGTCAGATTGCCCGTGCGGAAGTAGTTCGACAGCGCGGCATCGACCCGTTCGGCTGCATAGACGTTGCCGTGAGCA
AGCCTGCGCCAACGCTTCCGGTGTGATGTCGACCAGCTCGACCTGATCGGCCGCGGACGATCTCGTCGGGGATCTT
CTCCTTCTGCTCGATGCCGGTGATTTGCTCCACGACATCGTTTAGGCCCTCCAAGTGCTGGATGTTGACCGTCGAGATCA
CCGTGATGCCGGCGTCGAGGATTTCCTGAACGTCCTGCCAGCGCTTGGGGTTCTTGCTGCCAGGTGTGTTGGTGTGGGCG
AGTTCGTCCACCAGCACCACCTGAGGATGACGTCGCAGTACTGCCTCCACATCGAGTTCGGGAAACCTGGCACCCCGATA
TTCGACGTAGCGCGGCGGGATCATCTCGATGCCCTCGAGCAGTTTCGCGGTCTTGTTGCGTCCGTGTGTCTCGACGACCG
```

FIGURE 8(continued)

```
CGGCGACCACGTCGGTGCCGCGCTCCAGCCTGCGGTGCGCCTCGCCGAGCATGGCGTAGGTTTTGCCCACGCCGGGGGCC
GCGCCCAGATAGATCCGCAGCTGCCCGCGCTTGGTGGTCACATGCTCAATCATCCACCGGTAGGGCGTAAAGATCGCGCA
AAGATCGGCGAAGAGCAACGTCACGGTCGTGTTCCTGGGGGGCCCGGCAACTACCATCCTGCTGGGCTATCTGATGCGCT
GCGATGCCGGTGCACAAGAATCGAGAGGACTCACATGGCCGACTTGGTGTTGGTGCTGACCGTGATGGCCTTTGCCGGGC
TTTGCCTGCTCTACGTCCGTGGCTGTGAACGGATCATTCGCCGCGACGAAATCGGGGAAACAACAGTCGAACTCACGCGA
GCGCCGGCCGAATGGCGATGACTACGGTCGACAACATCGTCGGGTTGGTGATCGCGGTGGCGCTAATGGCGTTCCTATTC
GCGGCGCTGCTGTTTCCGGAGAAGTTCTGATGTCCGGGACGAGTTGGTTGCAGTTCGCGGCGTTGATCGCGGTGCTGTTG
CTCACCGCGCCAGCGCTGGGCGGCTACCTGGCCAAGATCTACGGCGACGAGGCCAAAAAGCCCGGCGATCGGGTGTTTGG
GCCGATCGAGCGCGTGATCTACCAGGTATGCCGAGTCGATCCCGGCAGCGAGCAACGGTGGAGCACCTATGCCCTGTCCG
TGCTTGCGTTCAGTGTTATGTCCTTCCTGCTGCTGTATGGGATCGCGCGGTTTCAGGGCGTGCTGCCGTTCAATCCGACG
GACAAGCCGGCGGTGACCGACCATGTCGCCTTCAACGCCGCGGTCAGCTTCATGACCAATACCAACTGGCAGTCCTACAG
CGGCGAAGCCACGATGAGCCACTTCACCCAGATGACCGGGCTGGCCGTGCAGAACTTCGTCTCCGCGTCCGCCGGCATGT
GCGTGCTGGCGGCCCTGATCAGAGGTCTGGCCCGCAAACGGGCGAGCACGCTCGGCAACTTCTGGGTAGACCTCGCCCGC
ACCGTGTTGCGCATCATGTTTCCGCTGTCGTTCGTGGTGGCGATCCTGTTGGTCAGCCAGGGCGTGATCCAGAACCTGCA
TGGTTTCATCGTCGCCAACACGCTGGAGGGCGCCCCCCAGCTCATTCCAGGCGGGCCGGTGGCCAGCCAGGTCGCGATCA
AGCAGCTCGGCCACCAACGGCGGCGGGTTCTTCAACGTGAACTCCGCGCATCCGTTCGAAAACTACACGCCGATAGGCAAT
TTCGTCGAAAACTGGGCGATCCTGATCATCCCGTTCGCGCTGTGCTTCGCCTTCGGCAAGATGGTGCACGACCGTCGTCA
AGGCTGGGCGGTGCTGGCCATCATGGGCATCATTTGGATCGGAATGTCAGTCGCGGCAATGTCATTCGAGGCCAAGGGCA
ACCCGCGGCTGGATGCGCTGGGGGTGACACAGCAGACGACGGTCGACCAGTCCGGCGGCAACCTGGAGGGCAAGGAGGTG
CGCTTTGGCGTCGGTGCGTCTGGGTTATGGGCGGCGTCGACGACCGGCACCTCCAACGGCTCGGTCAACTCGATGCACGA
CAGCTACACACCACTGGGCGGCATGGTCCCGCTGGCGCACATGATGCTCGGCGAAGTCAGCCCGGGCGGCACCGGCGTCG
GATTGAACGGCCTACTGGTCATGGCGATCCTGGCGGTTTTCATCGCCGGCCTCATGGTAGGCCGGACACCGGAGTATCTC
GGCAAGAAGATCCAGGCCACCGAGATGAAGCTGGTGACGCTCTACATCCTGGCGATGCCCATCGCCCTGCTGAGTTTCGC
CGCCGCGTCGGTGCTGATCTCCTCCGCGCTGGCGTCGCGGAACAACCCTGGGCCGCATGGTCTTTCGGAGATTCTATACG
CCTACACGTCGGGCGCGAACAACAACGGGTCGGCCTTTGCCGGTCTGACCGCGTCTACCTGGTCATATGACACCACGATC
GGAGTGGCGATGTTGATCGGTAGGTTCTTCCTGATCATTCCGGTGCTGGCGATCGCCGGCTCCCTGGCACGTAAAGGCAC
GACGCCGGTTACCGCCGCCACCTTCCCGACGCACAAGCCGCTCTTTGTTGGCCTGGTCATTGGGGTCGTACTGATCGTCG
GCGGCCTGACGTTCTTCCCCGCCCTGGCGCTGGGGCCGATCGTCGAGCAGTTATCGACCCAGTGATGATCGCACGCATGG
AGACCTCCGCAACCGCCGCGGCAGCGACGTCGGCACCCCGGCTCCGGCTGGCCAAGCGCTCGCTGTTCGATCCGATGATT
GTGCGCTCGGCGCTGCCCCAGAGCCTGCGCAAGCTGGCTCCGCGGGTACAGGCCCGTAACCCGGTCATGTTGGTCGTGCT
GGTCGGTGCCGTGATCACCACACTGGCGTTCCTGCGCGACCTCGCATCCTCGACAGCCCAAGAGAACGTCTTCAACGGTC
TGGTCGCCGCGTTCCTCTGGTTCACCGTCCTGTTTGCCAACTTTGCCGAGGCCATGGCCGAAGGACGCGGCAAGGCTCAG
GCGGCGGCGCTGCGCAAAGTCCGGTCCGAAACGATGGCCAACCGGCGCACGGCTGCGGGCAACATCGAATCGGTCCCTTC
GTCGCGGCTGGACCTCGACGACGTGGTGGAGGTTTCGGCTGGCGAAACGATCCCGTCGGACGGCGAGATCATCGAAGGCA
TTGCCTCCGTCGACGAGTCTGCGATCACCGGCGAATCGGCCACCGGTGATCCGCGAGTCGGGCGGCGACCGTTCCGCGGTG
ACGGGTGGCACCGTGGTGCTGTCGGATCGGATCGTCGTGCGGATCACCGCCAAGCAGGGACAAACATTCATCGACCGGAT
GATCGCGCTGGTGGAGGGCGCCGCACGGCAGCAGACACCGAACGAGATCGCGCTGAACATCCTGCTGGCTGGGCTGACGA
TCATCTTTTTGCTCGCGGTGGTGACGCTGCAGCCGTTCGCCATCTATTCCGGCGGGGGACAGCGGGTGGTCGTGCTGGTG
GCGTTGCTGGTGTGTCTCATTCCGACCACGATCGGTGCGCTGCTGTCCGCGATCGGCATCGCGGGGATGGACCGGCTGGT
GCAACACAACGTGCTCGCCACATCTGGGCGGGCGGTGGAGGCGGCCGGCGACGTGAACACGCTGCTGCTGGACAAGACCG
GCACCATCACCCTCGGTAACCGGCAGGCCACCGAGTTCGTGCCGATCAACGGTGTGAGTGCCGAGGCGGTCGCCGACGCC
GCCCAGCTGTCGAGCTTGGCCGACGAAACTCCGGAGGGCCGCTCGATCGTCGTGCTGGCGAAGGACGAGTTCGGGCTGCG
CGCCCGCGACGAGGGCGTGATGTCACACGCCAGGTTCGTGCCGTTCACCGCCGAAACCCGGATGTCCGGGGTCGATCTCG
CCGAGGTTAGCGGCATCCGTCGGATCCGCAAGGGTGCCGCGGCTGCGGTGATGAAGTGGGTTCGCGATCACGGTGGCCAC
CCCACCGAGGAGGTGGGTGCCATTGTCGACGGCATCAGCTCCGGCGGGGGGACACCCCTAGTCGTTGCGGAATGGACCGA
TAACAGCAGCGCGCGGGCCATCGGCGTCGTCCATCTGAAGGACATCGTCAAGGTGGGCATACGGGAACGCTTCGACGAAA
TGCCGCCGAATGAGCATCCGCACCGTGATGATCACCGGTGACAACCCGGCGACCGCCAAGGCGATTGCACAGGAGGCCGGC
GTCGACGATTTCTTGGCCGAGGCCACGCCCGAGGACAAGCTTGCGCTCATCAAGCGCGAACAGCAGGGCGGTCGGCTGGT
CGCCATGACGGGTGACGGGACCAATGACGCACCCGCGCTCGCGCAAGCCGATGTCGGGGTGGCGATGAATACCGGCACCC
AGGCGGCCCGGAAGCCGGCAACATGGTCGATCTCGACTCCGACCCCACCAAGCTCATCGAGGTCGTGGAGATCGGCAAG
CAGCTGCTGATCACGCGGGCGCGCTGACGACGTTTCGATCGCCAACGACGTCGCGAAGTACTTCGCCATCATCCCTGC
CATGTTCGTCGGCCTGTATCCGGTGCTCGACAAGCTGAACGTCATGGCGCTGCACTCACCAAGGTCGGCGATTCTGTCGG
CGGTCATCTTCAATGCGCTGGTGATCGTCGCCTTGATCCCATTGGCGTTGCGGGGCGTGCGGTTTAGGGCGGAAAGCGCG
TCGGCGATGCTGCGGCGCAACCTGCTGATCTATGGGCTGGGCGGTCTCGTCGTCCCGTTTATCGGCATTAAACTGGTCGA
TCTCGTCATCGTCGCCCTCGGGGTGTCCTGATCGTCGTCAATTACTGCCCGCGCTCACCATGCTGTTGGTGTTCACCGT
CATCACCGGCATCGTCTACCCGCTTGCCGTGACCGGCGTCGGGCAACTGTTCTTCGGTGACCAGGCGAACGGCGCGCTGC
```

```
TCGAGCGGGACGGGCAGGTCATCGGCTCCGCCCACATCGGCCAGCAGTTCACCGCCGCGAAGTACTTCCACCCGCGCCCC
TCGTCGGCAGGCGACGGTTACGACGCTGCGGCGAGCTCGGGCTCCAACCTGGGACCGACGAACGAGAAGCTGCTGGCGGC
CGTCGCTGAACGGGTCACCGCCTACCGCAAGGAAAACAATCTGCCGGCCGATACGCTGGTTCCGGTCGACGCGGTTACCG
GCTCGGGTTCCGGGCTGGACCCGGCCATATCGGTGGTCAATGCCAAGCTGCAGGCACCGCGGGTGGCGCAGGCGCGCAAT
ATCTCGATAAGGCAGGTCGAGCGTCTGATCGAGGACCACACCGACGCGCGTGGTCTCGGCTTCCTGGGCGAGCGCGCGGT
GAACGTGCTCAGGCTGAACCTCGCATTGGATCGCCTCTGACTCTCAGGCGGTAGTGGCGATCTGCTGCTCGATCATCGGG
AGCCGCACCCGAAACACCGTCTGGCCGTTGCCCGACTCGGCCGTGACCGAGCCGCGATGCGCCTTGACGATCGAGCTGAC
GATGGCCAGGCCCAAGCCGTGGCCGGACCCCATTGGACCGAGACTTGCTGGCCCGCACGAACCGGTCGAAGAGGTGGGGCA
GGATCTCCGGGTCGATGTCGGGGCCGTCGTCGGTCACCGACAATTCAACACACGGCGCGTTGGGACCAGTGCGGTGGCAG
GTGATCCCCGATGGTCACTGTGACGCCGGGCTGGGTATGCACCCAGGCATTGGTGAGTAGATTGCTGACGAGTTGATGCAA
GCGGGCATGATCCCCGTTGACCCAGACCGGCTCGTCGGGCAGATTCTTCACCCAACGGTGGGTGGGCGCCGCAACCGCCG
CGTCATTCACCGCGTTGATGACCAGGTCGGTCAGGTCGAGGTCCTCGGTTTCTAGATCTTCGCCCTCGCTGAGACGGGAG
AGCAGCAGCAGCTCGTCGACCAGCAGCGTCATCCGCCGCGCCTCGGATTCGATGCGGGCCAGCGCGTATTCGGTGGTGGG
CGGTAGGTCCGAGCTATCCTGACGTGTCAGTTCGGCATAGCCCTGGATCGCCGCCAGGGGAGTACGCAGCTCGTGGCTGG
CGTCGGTGATGAACTGCCGCATCCGCAGATCGGAATCGACGCGATGCGCCAGCGCACCATCGACGTTGTCCAACAAGCGA
TTCAGCGTGTGCCCGACGATTCCGACCTCGTTATCCGGGTCGGTATCCCCGGACGGACTCGCACGCTGATCTGGTGGTC
GTCATCGGTAAGTGGCATGGTGGCGACCTCGGCGGCGGTCGCGGCGACCCGGCGCAGCGGGCGTAGCGCATATCCCACCA
CCCACACCGTCAGTGCTGCGGTAACCACCAGTGCGGCCCCAACAAGCGCGACGGTGGTGACTTTCTTGCGGGCGATGATC
TGGTTGGCCAGGCTTAGCGATACGCCGACGAACAGTCGATCGGCGCCAGCGGCGCTGCTGTCAACCTGGTAGGCGCCCAG
GCTGCCCAGGCTTTCGACACGCGGCGGGCCGCCGTCCCACACTTGCGCTTCGATCGCGCGGATGACGTCGGGCGGAGCGG
GTCGTGCTCCGTCTTCGGAGAAAACGGCCGATCCGATCACCACGCCGTCGTGCAGCACGGCAATGAGGTTTCCGGGCGTC
TGGCCGGTGAACTCCAGCACCGCTTGTGACATCGGGAGGTTGCCGGTGGGCGTGGATGTTTGCGCACTGTCGCGGTATCT
GGTGTAAGAGTGGTTCAACGCGTGCAGGGATTCGACTAGCTCGGCGTCGTTCATCGCGGTGACATAGCCGCTTAGGCTCA
GCACGGAGACGACACCGACGGCCACCAGCACAACGGTAACGACCGCCAACACGCCGAGCAGCAATTGCTGGCGTAACGAG
CGGGGTCGCCAGCAGGGGGCTTTTCTGGACCGAGTGTTTCGGTCCGGGATCATGCCAGGCTCATTCCGGCGGACGCAGCA
TGTATCCAATGCCGCGGACCGTATGGATCATTGGCTCCCGGTCGGAGTCGATCTTCTTCCTCAGATAGGAGATATACAGG
TCGACAATGCTGGTGCGGCCTGCGAAGTCGTAGTTCCAAACCCGATCCAGGATCTCGGTACGGCTCAGTGCTCGTCGGGG
ATTGCGCATCAGGAATCGAAGCAGTTCGAACTCGGTCGAGGAGAGCGAGATCGGCGTACCGTCGCGGGTTACCTCCCGGC
TGGCCCGTCGAGCGTAAGGTCTCCGACCCGGAGTGCCTCATCGGCGGGCCTTTCCAGATGGCTGGAGCGGCGCAGCAAC
CCGCGCAACCGGGCGACCAGCTCCTCGAGGCTGAACGGCTTTGTCATGTAGTCGTCGGCGCCCGAGGTCAGACCGGTGAC
CCGGTCCATCACGGAATCGCGCGCGGTGAGGAACAGCGTGGGTGTGTAGACGTCGGATTCTCGGACCCGTCGCAGGATTT
CCAACCCGTCCACATCGGGAAGCATGATGTCGAGGACCAGCACATCGGGGCCGACCTTGTCGAACTTGGCTATGGCCTCT
TGCCCGTCGTGGGCGACTTCGACATCCCAGCCTTCGTAGTGCAGCGCCATCTTGACCAGATTGGTCAGCGCTGGTTCGTC
ATCGACCAACAACACCCGGATCGGTGATCCATCCGCGCGATGAATCCGTGGCAGCTGCCCCAGGATGGCTTGCCGCGGAC
GTTGACTGCGCGTGTACCCCGACATCGTCGTCATGCTCCCGTATCCTCTCAAGTCCTGTGCAAGCGCACATGCAGTTGTC
ACGGGATTCATAAATTTTTCAAATGTCGCTTATGTAGTTACTTCGGCCTGAAAAGGTGACCGGGCGGGATGTCGGGCTTC
GGCGGTGAGAAAGCGGATCTCGGTTTCCGGGTATACGGAGCCCCCGGTGGACCGGTTATGCGGGAGGGCGCTGATCGTG
ACCAGGTTGTGGGCGAACACGCCGTGTCCGACCCAGGTCCGGGTGCCTTCGAGACCGCCGATCCGGCCGCGGTCCCAGCC
GTAGCCGCGTTTGAGGTGGCTGATCCGGCCTTCGCATCCGGTCCGCCATTTGATGGTGCGGCGGAACGCTTTTCGGTGTT
CTTCGGCGCGTCGATCCTGCGAAGGTTTGCCTTTGCGCGGGATCAGCACATTCTTGACGCCCACCTCGGTGAGCTGCTGG
TCGACGGCGGCTTCGCCATAGCCGCGGTCGGCGGTGACGGTGCGCGGCGTGCGTCCGGCGCGCTTTTTCACCCACGCCAC
CGCTGGCGCCAGCTGCGGCGCATCGGGTGGGTTGCCCTGCTGCACAGTGTGATCCAGCACAATCCCGTCATCGTTGTCGA
CGACCTGGGCCTTGTGCTCAAACTCGACCGGCTTACCGAGCCGACCCTTGGTGATCGGGGCGGGCATCACCGTCGTGCAG
GCTGACCCGTCGACTCGCCCCGTCCGAAGTGATGCCCGCGACCCGCTGGCGGGTCTGCGCCACAATCTGACGCGTCGCGT
TGAGCAGCTCGGTTAGGTCGTTGACCGCGCGCACCAGCCCACCACAGCGGCGACCCGCGACCGCATCACGCTCACCGCGG
GCGGCCAGCGCGGCGGCCTTGGCCTTGGCCCGGAGCACCGCCTGCTTGGCGTTGTCCAGCAGCTGCTGGGCCTCCTGAGC
AGCGGCTTGGGCCAGCTCGGCCAGCTCGCCGGTGAACCTCAGTACCGCGGCCCGCGCTTCGTCACGCCCAGCTCCGCAC
GCGAGCGCAGTTTCGCTGCGACCGCGTGCGCGCGCCGACCGGCCGCGCGGGAGCGGTCGCCAACCCGGGTGCGCACCGCG
CCGCCAGCGGCCTGAATCCGTTTGCCGGTTGCGGCGATCCGGCGCATTGCCTTGGCCAACAGACCCAAGTCGGTCGGATA
AGACACGTTCGCCCGCGCCACCGTGGTATCGGCCCGGATCCGATTGGTGCCCAGCAGCTTGGCCTCGGCCGCCTTGGCCA
ACAATGCCTCGTTGAGCCCGTCGATCGCCGCCGATCCGCAACGCGTGGTGAGCTTCATCAATGTGGTCGGATGCGGCACC
GACCCGTCCAGCGCAATGCGGCAAAACCGCCGTCAGGTGATCGAATCAGCCACCTCCCGGCACAGCGACTCATAGCCCAG
CCGGTAGCGGAACTTCACAAACATCAACTGCAGATAGACCTCCATCGGCGTCGACGGCCGGCCCCTGCGCGGGTCGAAGA
ACGGCACGAACGGGGCGAAGAACGCCGGATCGTCCAACAATGCGTCCACCCGGGCCAGTTCCTCGGGCAGTCGGCGCACC
TCGTCGGGCAGCAGCGACTCCCACAACCAGCACTGATCGCCTAAAGTACGAAACACGATGGCCTCAATCCCTTCCGCAAC
AAGGGCATTGAGGCCATCTTCCCAGTTCAGCACCATCCGACCGGGGATCAACGCGCCGACTTTAGCAGGTCGAAGTAGTT
```

FIGURE 8(continuated)

```
AGTCGTTCAGATAACAACGTGGCCACACACCAACCGGTGTGCGGCCACGTTGTAATTGACGGCGCGGGCCTTAAGCCAGC
TTTAGGCCCAGCTGGAGCCGACGGCGCTGTCGGTTTGTGCCATGTTGTTGCCGGCAGCCTGCACCTTCTGCCCGTGGGCG
TTGGCCTGCTCGTAGATCACCTGGAAGTTACGGCCCAGCTGGGTAATGAACCCCTGGCAGGCCGCCGAACCGGCGCCGCC
CCAAAAGTCACTCGCGGTCAACACATCAGAAATGATGGCCTGATGCTCGGCCTCCAGCGACCCGGCCTGAGCGCGGATCA
TGGCGCCGTGAGCGTCGACGTCCCCGAATTGATAGTTGATGGTCATGTGTCCTCCTGAGTCGTCGGGCCGGGTCAGCTGC
TGAGGATCTGCTGGGAGGCCTGCTCTTTGCTGTTCGTAGTTGTTGGCGTCGCGAACCAGCCCGTCACGCACCCCGTGCAGC
ATGTTCACGATGTTGCGAAACGCCTGATTCATCTGGGTCATGGTGTCTAGCGAGGTCGCCTCGGCCATGCCACTCCAGCC
CGCGCCCGAGATGTTTTGCGCGGACGCCCACATCCGGCGAGCCTCGTCCTCCACCGTCTGGGCGTGCACCTCAAAACGGC
CCGCCATGTCCCGCATCGCGTGCGGATCCGTCATAAAACGCGAGGCCATGCTGCTGTCTCCTTGTCTCGAAGTCGTCACG
TTGTTGAAGTTCTAGCGGCTGTGATCGGCGCGGTGGTGGCCGCGTGGCGGACAGGTTATGACTCAACGGTTAATTGCTGG
CCTCAAACGAGTGAGATGTCCCCCTTTGTCCGCATCACACGACGACCTGTTTGGGCATGACAGTGGGCTTGAATCCGTAC
CGCGGCCCGGCATAGGCACCGGTGCCCTTGGCGGCCGAGGCCATTCCCGGCATCATCCCGGTAACTGGGCCGGCTTCTTC
GGCGGCGACGGTCCAGCCGCTGCCTTCGAGCGCTGTGGCGCCGGCGGTTGTCGCCGGTGCGGCCGTAGACCAGGCCGCCG
GCACTGACAGCCGGCCGACCAGGGTGGCCTCGCCTAAACTTGCGCCGAGCCCCGCTGGCGTCACCGAGTCCGCCAACCCC
GCGGCGGCCGCACTGGCGGCACCCTCGGCAGCCTCGATGGCGCCTTCGGCGATCGCTACCGGCGCCCCACTGTTCAGGGC
ATTTGCTAGGAATATCGCGGTGGGGATGGCGGCGTTGACATACCAAGCGGCGGTGTTGACTGCGCTGTTGATGATGTTTG
CCACGAACGGGGTCGCGAGCAGGGCGTCGATGTCGGCAATGATTCCGCTCAGCCCCGTCGAGTCGAGAACCGATGTGACT
GGGGAGGCGAGCCCACTCACCGCGTTGGGCAGGCTACTGATCAGGTCCGCTACGCTCACCTGGTTGACGGCGGCGGTGGC
GGCAGCCGAGCCGACCGCGGCGGACTGGGCGGCCAGCCCGCCCGGGTTGGTGGTCTGCGACGGCGGGCTTAACGGTTGCA
GCATCCCGGCGGCTCCCGAAGCGGCCGCGTAGCCGTACATAGCCAGAGCGTCCTGAGCCCACATCTCGGCATAGAGGGCT
TCGGTCGCCATGATTGCCGGTGTGTTGATCCCCAGGACGTTCGTCGCGACCAGGGCCGCCAGCAGCGCCCGGTTGGCCGC
GACCACCTCCGGCGGCACTGTCATCGCATAGGCCGCCTCGTAGGCGGCCGCCGACGCCATGGCCTGCGAGCCGGCATGCG
CAGCGGCTTCGGCGGTGTAGGTCAACCAAGCCAGATAGGGCTGGGCTGCGGCGACCATCGCCATCGAGGCCGGACCCATC
CACGACTCGGTGGTCAGCCGGGTGATCACCGACTCATACGACGCGGCCGTCGTACCCAACTCGGCGGCCAGGCCGTTCCA
TGCGGCCCCGGCGGCCATCATCGGTCCTGCACCCGCGCCGGCGTACATGCGTGCGGAGTTGATCTCAGGGGGTAAAGCTC
CGAAATCCATGGGGTATTCCGTTTCCGTGGAGTTATTTGGCTGAATTTCGTTGTTGGTTGAGCGTGGCCGCCCGTACGTC
TGCCGCCTAGACGGTTGCTGGCTTGGGCATGACGATGGGTTTGACGCCGTAGCGCGGTGCACCGAAGCCGGCGCTGTTGC
GTGCGGCCGAGGCCACCCCTGGCATCCCGGGGATGAACGTCCCCGCGGCGGCCTGCGGCGCGGCGGTCCAGCCCGCG
CCCGGCAGTGTGCTGGTGGTGGATACCAGGGTCGCCTGTCCGGCCCAGGCGGGCGGCACCGACAACATGCCGATCGCGGA
TGCGCTGCCCAGGCCGGCCGCAATTCCGGCCTCGCCGAGGGCGGCTTCGGCCGCGCCCAATGCACCCAATTCGCCCAAGG
CGGCTTCCCCACCGAGAGCCGAGGCGGCCTCGGCCGCCTCCTCTGCAGGCAGGAGGCCGCCGCCGGCAAGGCCGATCAGC
GTAGACGTGGCGGAGGCCCAGTTCCCGGCCCCGATGTTGAGGATGTTGCCAATGCCACCCGAGAGTTCGGGCGGGAACAA
CCCCGTCGTCGCTTGGATGATGGCCGACGCTTCCCCTGTGATCCCCGAGAGTGGCGAGGCGGCCAGCCGATGAGTTGAGCG
ACTCGGTGACGCCGTAGGTACCGGCGCTGATTCCCAGAGTGTTGACAAACATGTCATGCATAGCCTGAGCTTCGGCGCTG
ACCTGCTGGTAGAAGGTGCCGTACGCAGTGAAGAGCGCCGCCTGCAGCGCCGAAACCTCATCGAGGGCCGCCGGAGCGAT
GGCTGTGGTGGGCGCCGCGGCGGCAGCGTTTTGGGCTGCCATCGCAGCACCGATGGTCCCGAGTTGCGCGGCCGCAGCCG
TCAACTCTTCAGGCACTGTCTTGAGGAATGACATCCATTGCTCCTTGTGTGTGAAACCTGCCGGCCGCTAGCACCCCGGG
CCGACCCTGTGTGTTTGCGTACGGCTGCCTGTGGATTGGCGTAACGCTAACCGGCCAAGCCTCCACAGTCGCGACCGAAA
GGCATGGGACGCCCGACGTTTACGGTTTTTTAACGTTTACGTCGACATCCTTAACAAGGTCTTGGCGGCTGACATGGCGG
TGTGATCTGGTGCCCGGGCTAGCACACTTCGGCACACACAAATGAGACGCGGCGGCGCGGATTCTAGGCGAATGACGGCTC
TTTCGCACCTGGCGTGTCGCGGTAGGGTTGGTGCACTGGATCGGGTCCAAGCGCTACATTCGCCGTCAAGCCTCCACAGC
CCGATTGGCAGAGGCAGCGGACAATCCGCGCTCACGGGTGCTGGCGTTTGCTAGTGCCGGTAATCTTCGAAAGAGTCGCT
TCTAACTGCCAATATGCCGGGTCGAAGCCACTGTCCAGCACTGTCGGCATCCAGATGGGGCGTTGGCGCGCTGATCGAT
ACGCCGTCTGCGCGGCTCCCGGCACAATGAGTTCGTGCCCGATTCCTGGCCGGTCGTTTGCGTTGACGACTGGTCTGTTG
CCGGCCTGGAGACCCAGGGGCAACACCCGCACGATTGGCTCAAACATTCTTCGCAGAAGCGGACGTGGCTCTTCAAGCCG
GCGCGACCGGAGCCGCGATCGTTTACTCGGCGAAGACGTGGCAGAAAAGCTCGCCAGCGAGTTGGCGGCTACGCGATGT
CTCCACAACAAGAGGGGAAGCTCACCCGTCGTGCAAATGCTGAGCGGGGTCTGGTCGGTCAGCGTGAACCCGAGGCTGG
CCGCGTGGTCGAACGATGGGCACAGCGCCTCCACATACTTTGTCTCCAGCGGCGGCACATGGACCGCCCAGTTGCGGTCG
TGACGATCACCGTGGGCGATCAATGCGTCGAACGCGAGGTAGGTCGAAAGCGCGGAACGTGGGTAGGAGCGCTTGGTCGG
CAGGTGCTGCGAACCGAGCAAGCGCCTGCTGGATCGCCTCGACGTTGTGCCCACGTTGCCCGGGATCGTCCCGGTCGCAG
TTGAGCACAACCTCGGGCATCAATGCTTGCGGCAACCGCACGTCCTTGACCAGCGCACCGCGCACGCCGTCACGGACAGC
CAGCTGGACCCGGTGCCGCAGGTATCCCGACTAGGGCGTGTCTCCAATTTCGGAGTTCCCACTCGGGCGTGGATGACGGC
GCAGGCCAGCAGGACGCCGCCGAGGTAGGTCAGGGCGTATTTGTCGTAGCGGGTTGCGATGCCGCGCCACTGCTTGAGTC
GATGGAAGCCGCGTTCGACGGTGTTGCGTAGCCCGTAGAGCGCGGCGTCGAATGCTGGTGGCCGCCCGCCGGCAGACCCC
TTGGCCTTGCGCCGGTCGATCTGATCTTGGCGTTCGGGGATGGTGTGCTTGATCTTCTTAGACCGTAATGCGGCACGGGT
ACTTGGGTGTGAGTAGGCCTTGTCGGCGAGTAAGCGGAAATCCGTGCTGCCCAGGGCGTATTCGGTGCTGGCATGGCGAT
```

FIGURE 8(continued)

```
AGTCGTCGAGCAGGGGCAGCAGTTGCGGGTTGTCGCCGGCCTGGCCTGCGGTCAACCGGATCCGCACCGGGGCTTCGCGC
TGATCGGTCAGGGCATGGATCTTGGTGGTCAGCCCGCCGCGCGAGCGGCCGATCGCATGATCGTCGGGTTCATCGGCGGA
TTTCTTGTAATCCGACAGTGCCCCCTGTGGCGAGCGTGTCCGAGCAGGCGCCCGCCGAATGCTGGTGTGCCCGCACGTTC
GTGGAATCCACCGACAGCAGCTTCTCGATATCCTCGGCCACCTCAGCGTCCACCCCGAACACCGCGGCAACGTGGCGAA
CACCTCGTCGCAGGTACCATCCAGCGACCAACGGTGATGGCGCTTCCACACCGTTTGCCACGGCCCGAACTCAGCGGGCA
GGTCCCGCCACGGACTTCCCGTACGGAACCGCCACGCGATCCCTTCCAGGATAAGCCGGTGATCGCTAAACCGTCTGCCG
GGCTTGCCCTCATGCGACGGCATCAACGGCTCGACCACGGCCCAGAACTCGTCCGAAATCACACCCACTCGCGTCACCGG
CCAATCCTCGCTGGCCAGTACCTAAAAATTTGGGAGACACGCCCTAGGCGCGGGCTGCAGCGGTAGTACTTTGGCCTGTT
CGGCGCATCTCCTATGGCTGCGGCCCGCTGGCTCAAACCTTGCCTTGCCACGCCAAGCCATTCCTAGCCTTGCCTAGCCA
CACCATGCCCTGCCTAGACACAGCGAGCCTACGCCGCGTCGAGTTCGGCGAAAATCAAACTGACCCACTACCACCGGATT
GAAGGGTTTGGTGCGTGTTGATACGTCCCGGGTTGTGCCTATGGAGGGTGTCCATCTCCACGATGCCGCCGAAGTCGAG
TTCGTCGAGTGCTCGGATCACTTCGCTCGACGGGATGCCGCGATAGAAGGGTGCCGCGTTCGGTCCGGTGCCCGTCGACG
GTGCTTCCGCAGAGTCCTCGACCACGAGGCCGATCACACGGCCGTCTTGCGCAACGATCGGACCGCCGCTGTTGCCCGGC
CGCGCGATTGCCGAGTAGAGGAAAATCTTCTGCCGGCCGGGGATAGTCGTCGCGGCCGGGTTGACCACCTCGCCACGCTG
CACCGTGATCGCCATCTCCGCAGTCATCGGCACCCGCGGGTAACCGAACACGTAGACCTCATCCGCCCAGTCGGGATCAC
GGAACGCCATGCCGCCAAGCCGCGGGATGTACTTGCCTTCGGGCATCTCGAATTTGATTACTGCGACGTCGAGCGTGGGG
TGCGGGTGAGCGGTGCCCGAGAAGTTCACCAACTCGGCTTCGGCGTGGTTGCTTGACGGATAGACGGACAGACCTGCGCT
CGTGCCCGCGAGCCCGGTCACGACATGTTTGTTGGTGATGACGTGATTGTGGTCGACGACGAGGCCGGTTCCCCAACTAT
CCACCGGATTGCCAGCGTCGTCGTGACCGGCGAGTTGAACGGTCACCGCGTTGTAGCTCGGGATGATGAGCTCGGCACCG
AACACCTCGGACAACCAGAGGTTGCCGCCACGCTGTCCCTTCGATATCGCCCCTGCGAGATGTACTTCTGCCCCATGAC
TGGCAATCGCGGGTCCCAACCGAGCGGCAGCAGAAGTCCCGCGCGTTCCATCGAGCTGAGGATGCGGTGGAGGGTCACCG
CGTCGCCCGCGGCGGGCAGGCCGAGGGTGCTCAGGTATCGGGAGAAATCTGCGACCGACCACGGTTCGAAGGGCACCGTC
GTCGGCAGACCGATATCCGAGTCAACCGGTGGTGGTTCGGGTTTGCCGATCGCCGCCAACCACCGGGTTGTGGACCAG
CCCGAAGAATTGATGGGCGCACATCGCCACGTTCACACGCCACGCAGGAGTCCCGGGCTTCAGGTCGGCCGCCGTGAGCT
GTCGCGGTCAGGTGCTTTCCGCGCCATCCGCCGTCACCTCTGCCATGGTCCATCTACGGTATCTGCGACAAGGGCAGCGT
CGATGCCTCGACATGCAGAGTCGGTGTTCGCTTCACGCGAACTAGGCGCGCCTAGCCTGGACGAGTCCCCGGGCCGACAT
TCGCCCGAGGCCTTGGCCTCCATCACCTAATTGTGTGCAAAACCGTATCTAATTGATACGATTGCGCACATGGCTATCTG
GGATCGCCTCGTCGAGGTTGCCGCCGAGCAACATGGCTACGTCACGACTCGCGATGCGCGAGACATCGGCGTCGACCCTG
TGCAGCTCCGCCTCCTAGCGGGGCGCGGACGTCTTGAGCGTGTCGGCCGAGGTGTGTACCGGGTGCCCGTGCTGCCGCGT
GGTGAGCACGACGATCTCGCAGCCGCAGTGTCGTGGACTTTGGGCGTGGCGTTATCTCGCATGAGTCGGCCTTGGCGCT
TCATGCCCTCGCTGACGTGAACCCGTCGCGCATCCATCTCACCGTCCCGCGCAACAACCATCCGCGTGCGGCCGGGGCG
AGCTGTACCGAGTTCACCGCCGCGACCTCCAGGCAGCCCACGTCACTTCGGTCGACGGAATACCCGTCACGACGGTTGCG
CGCACCATCAAAGACTGCGTGAAGACGGGCACGGATCCTTATCAGCTTCGGGCCGCGATCGAGCGAGCCGAAGCCGAGGG
CACGCTTCGTCGTGGGTCAGCAGCTGAGCTACGCGCTGCGCTCGATGAGACCACTGCCGGATTACGCGCTCGGCCGAAGC
GAGCATCGGCGTGACCAAGCCCTATTCGTCGCCGCCAACGAACCTGCGCTCACTACGAGATCGGCTCACCCAAGTAGCGG
AACGGCAAGGTGTCGTGTTCGGTCGACTGCAGCGGCATGTCGCGATGATTGTTGTCGCACAGTTCGCGGCCACGCTCACC
GACGACACCGGCGCTCCGCTGCTGTTGGTCAAAGGCGGATCGTCGCTGGAACTGCGCCGGGGAATTCCCGATTCGCGGAC
CTCCAAAGACTTCGACACGGTCGCACGTCGCGATATCGAATTAATCCATGAACAGCTCGCTGACGCGGGCGAGACGGGGT
GGGAAGGATTCACTGCAATCTTCACCGCCCCCGAAGAAATCGATGTTCCTGGTATGCCGGTCAAGCCGCGCCGATTCACC
GCCAAGCTGAGCTACCGAGGCCGGGCTTTCGCAACTGTTCCGATCGAGGTCTCCTCCGTCGAAGCCGGCAATGCCGACCA
ATTCGACACCCTCACCTCAGACGCGCTCGGCCTCGTGGGCGTACCGCAGCAGTCGCCGTACCCTGCATGACCATTCCCT
GGCAAATCGCGCAGAAGCTGCACGCAGTAACTGCCGTGCTCGAAGAACCGAAGGTCAACGACCGCGCTCACGACCTGGTG
GACTTGCAGCTTCTTGAAGGACTGTTGCTCGATGCCGACCTCATGCCGACGCGCAGCGCGTGCATCGCGATATTCGAAGC
GCGCGCCCAGCATCCTTGGCCACCGAGAGTCGCCACGCTGCCGCACTGGCCGCTGATCTATGCAGGTGCGCTGGAGGGGC
TTGACCACCTTGAACTCGCCAGGACGGTCGACGCGGCGGCCCAGGCAGTGCAGCGATTCGTTGCGCGGATTGATCGGGCG
ACGAAAAGATGAGTGCTGGCGCGGCCTGCGGCGCACGGGAGAACACAGGGACCACCCCGGTTCCATAGTCAACGTCAGCG
GTGCGGGTGTCGATCAGACGACGAATGGAATCGCCCTCGCATTCCTCGCGATCGAGTGCCTATGAGCCGCGCTCCTGCGG
CCTAGGCGAGCGCTTCCGGGGCTCTCAGACATCGGCCTCGTGGCGGTGTGCGCGGCGGCATGTGGCTCTGTGATCTCTTG
CGCGAGCGCCGATTGCGAATTTCGTCCGGCGAAAAGTGACCGCTCCGTGACCTTAATGCAAGAGGTGTGTGGTGTGGAGA
GGGGCGGGAGGAAGGGAGTGAGGCGACGGTGTCGAGATGCAGCGAGGATTGGTGGACTTCCGGTAGTTGTTTAACAAGGC
CCCGGAGACCAGGGGGCGAGGGAGAGCGCGGGCCGACTTGGGTGGGTGAGCCTGGCTTGGGCTGGTGCGTGAGCGGAGGA
TCGCTGGTGGCCCCGTAGTTGGCGTTGGCCTGCGGACGTGCCGCGCCTGCGAGGGATTCGTCAATCTTCCTGTTGATGTC
GCCCGTGCCACGTCGGTGAGATGTCGAAGGGATGTGACCTGGTGCGTTCGCGAACAGCTGCTGACCACGGCCACCGACGG
CGCTCAACTGTCGTCGATTCCATCCCACCCGTGCTTGGACTTTCAAACTGTCCGGCGCCGATGGGGAAACCTGGTGTTTG
GCCGGAACGTGGCGCCGAGCCTCGATAATATCAGCAGTTACGTCCAGGGGTGTGGTGTACGGGCAGGTAAGGCCGGTGGG
CGTGTCGTAGCCCAGTAGTGGGCGGTCATCGCGTGATCCTTCGAAACGACCAGCAAAAGTCAATCGAAGGAAATGACGCA
```

FIGURE 8(continued)

```
ATGACCTCTTCTCATCTTATCGACGCCGAGCAGCTTCTGGCTGACCAACTCGCACAGGCGAGCCCGGATCTGCTGCGCGG
GCTGCTCTCGACGTTCATCGCCGCCTTGATGGGGGCTGAAGCCGACGCCCTGTGCGGGGCGGGCTACCGCGAACGCAGCG
ATGAGCGGTCCAATCAGCGCAACGGCTACCGCCACCGTGATTTCGACACCCGTGCCGCAACCATCGACGTCGCGATCCCC
AAGCTGCGCCAGGGCAGCTATTTCCCGGACTGGCTGCTGCAGCGCCGCAAGCGAGCTGAACGCGCACTGACCAGCGTGGT
GGCGACCTGCTACCTGCTGGGAGTATCCACTCGCCGGATGGAGCGCCTGGTCGAAACACTTGGTGTGACAA
```

FIGURE 8(continued)

```
GATCCTGAGCCGCTAGACACGGCCGCTCCATGAGGTGCAGTCATAGCTGAAATTAGGTGCCGAGGAGATAACAATACGTC
GTTAATTGGGAGGGCGTTGAAGTATATGGTCAATACCGCATGGTGACGATGCGCTCGGGCGCGTTGGTCGAATTGGTCTG
GGATCCCACCAGATCCAAACAGTCTTTCGGAGTATGTTGGTCCGTCGGGCTATCGCGCAGTCGTTGAAGCCGTTGGCGAC
GGGTAGCGGAACGGCTTCGAATTATTGTGCCGATCGCATCTGTGTGTTCCTTGCACCGACCATAATGAACCCAAGGTGGG
AGGGCTGTCTACGGGTTCGTCGGTGAGCGGACCGGTACCATTGGCAGGCTCGCGGGCGTGATGGAATGGCAGACATGCCG
GCTTTAGGTGCCGGTGCTTGAAAGAGCGTGAGGGTTCGACTCCCTCCGCCCGCACTCTTCAGCTGAACAGGCCGCGGTGT
TGTTCCACGTAGAGCTGCACTGTCTGTGCGGGATGGCCGGTGGTGTCTTCAACATCGTAGGTTGAGCGGCGATAGCGGTC
TTCGCGGTGCAGTTTGGCCGTGGTGGCGATGTGTTGTCGCACATGCTGGGGCCGGCTAATTTATAGCTTATCAAGAAGCG
CTAGCCGCTCGTTGTCGGACGGCTAAACGGTGCTGATGGGTCGGCCCAGGGCTTGTGTGTTGCTTTGCCAGCTCATCG
ATGTCCAGCGTCGTCAGCCAGTCAATTCATAGACCACGCCCAGATGATTCGTGGGGTGTGCACCGCGGTGACGATGTCGC
TGGATGCGACGGGCGAGGTGCGGTTGGCTCCGAACGGTAGGGGCAGTTGGTCGCTTTCCCGGACTGAGCGCGCGGCCACT
AGGGCGAAGAACGGGTTCTTGAGCAAGATAGTCGGCCTGATGTGTATGTGTGGGGAATTTTAGCAGCTGACGAGGTGTTA
AGCGAAGACGATTCCTCGAATCCGTCCAGAACTTTGGTCGTGGTGTCCCTGATGAGACCGTAGTCTTCGATGTAAGTCGG
CGGTGCGCACAACCGCGTCCTGGGCAAGGATTTGCTGGAACTCCTCGCCAGAGATTGATTCTGAGGACTTCTGCGGTGGT
TATTGGCTAACGCTCCTCGCTGATGTCGGCCCGGCTCGAATCTTCGGCTCTACCGAAACCTTACCTGGTATTTGTCGAGC
GCCCTGAAAAGCAATAGTGGTTAGGGATGTGGGATACAGGTGGCGTTGCTAAGTGATTGGATCACGGTGGTCACAGGCGG
TGCACAAGATCTGGGTCTGGCCATTGTCGAGTGGCGCGTTGTGGAGGGCGCGGGTGGTGCTCGGTGGGAGGACCTTGAGA
CAACCTGGAGTTGCGACGAAACAATTGGGTGGTGCAGATGTTGCCTTAGCGGTGTTGTGCAAGTAGCAAGTAATTCGTGC
AGCCGACGTCGACGTCCTATCCTCGTGCGGACGGCCGTCGAATAGTTTCGGTGGAGGTGGACATCATGGCTAACGCCGTC
GGGATCACCCGCGTTACGGTGGTGCGCAAGATGACTGAAGAGCAAGTCGACGCGGTCATTGTTGGTGCATCTGACGGGGG
ACTTGAAACGGTGCCAGGATGGTGGCAGCGATCATGCGGGGGTAACAACGTGGCGTAATTGTGACCATCTTGTAGGTGTC
TGGCATGGCCGGTCAGACCAATTATTCGGCGGTTAAGGCTGGGAATGGTGATGACCAAGGCTGGGGTTAAAGAGCTTGCT
TAAGCTAGGTGTTCGGGTGAACGCGATCGCTCCTGGGATGATCCGCTCGGTCATGACCGAAGCAATGCCGCAATGTATTT
GGGCCGCTAAAGTGGCGGAGGTTACAGTGAGGTGAGCTGGGGAGCCTAGCAAAGTGGCCAATGCCGCTCTAGTGTTTTTA
TTTTCGATCTGTCATTGCATATGCCCGGAACTGTTATGGGAAGTCACTGGCGTTCTACACATCTGAAACCAGGAGAGTGG
CTATGCGCCAAGTTGTTATTTATTGAAACCTAGCAAGTATTTGCGGTGATGCGACAGTGGAGTTTCGTTGCCGTCGAACG
GGAACGAACTAATATGCACGGTTAGGAAATCTCACTAGGTCACCCCGTGGGTGTTACCGGTGGCAGGGTGTTAATCACCT
TGATGCGCTAACTCGATTGTCGTCAGGAATGTTATGGGTTGGAGGCTATGTGCAATCGGCAGCGTCGCGATCTTCGAATG
GTTTGCGTCAACATGAATGGCCCTGGGTTGCCGCTGATCGGTGTCAGCGTTGTTAGGGTGTCAATTTTTGTCTTCGCACC
TTTGTGTGCTGCAATGTTCAGCCAGCTTGGCGCGGTGATCCGTGTGAATCTGATCAGCGATGCCTCCGACGTACATCGCT
GGCCGATGCGACAGACGGTACGTCGATTTACTGTCCTGATCAAGAGAAAGCGTTCGGACACGATCGATCTGCTTTCGAC
CGAAGGGTAACAGCTCGTCCAGCTGCTGGTCGTCGAGGGGGACGACATCGTCGTCACCAACGTCGTTAGCTTGGCCAGGG
TAGGCCATGATTGCTTGGCTGCCAAGCGTTCCGATGTCGTTGATGTTTCACCTTGCTTGGGTGCGTCTGCGGTGCCACCG
GTGTGGATTACACCGTGAACGCGAATGTCGGATTCCCGCTCGTCACCGGCCCGGCCAATCATGACTGGGCCTATCCAGCC
ATGTGTTACCGGTCTGGGATGTGTGTTGTGGCATCTACGCTGTGCTGGCCGTCGTGGTCGCTGTCCGCTGCCGTGACCAA
TCTGGGGTAGGTGTACACATCAGTCTGGCACTGGAGGATGTCGCGCTGGCCACTGCTAGACACTTCGGGTTATTGACACT
GAGTACGCAACGCCCACGTTTCGACAACGCCATCTACGGCCATTACGGTCATGATTGCATATGATTGTATTCAGTCGTGA
TGGGACAGCGTTCATAATTGCCGGGTTGACCGGGAGGAGCTTTCGCGACTTGGTTTAGGTAATCGGAATAGGGGTAGCAG
TGGCTGCGCTTGCCACGGTGCTCCGTGTTGACTTTGACGACCAAGGCGTCCGGAGTATCGGTATCTTGAAGTGTTCTCCG
GCTTGCTTGCGACCTAGTCGAGCCAATTACACAGACGAAGATATCACACACCGTGTTGTTGGAACCACTGTTCTGTTTGA
GCGATACCGCACGTTCGCAGAGGTTGCCGATGACGAGCGGGTAATTTGCAATCTGTTGTTCCCCGGTTACACAGCCTGGT
GTCGGAGAGTGTTTCGCCCTCGGGATGTCGGTCGCGTTCGACGGTACTCATCCCGCTAGCACGCTCGCCCCGGATAGATG
TCCTCACCAACTGTTTGAGCTTGACCAACGCCGACATCACGCGCTTTTTAAGTGCTAGAACGATCGTTGGCTGGGTTGCG
GTAAGGAAATTCGTCGACAAGGACAAGGAAGTCATTCTCAACGCGCCGTAACGAAATGCGGTGACGCCTATGCGCAGGAC
ATCATCGATCGGATACGGGATATGGGTCCTGTTCGGATTGATGATTACGCAGACTTACGGCGTCCTGGGGGAGTCGTTAT
TGACCTACTCGTTTACGCGTTGGGCGTTGAGGAGCTGGCGCGCGGCAGGATGAGTGTCTCTAAGGTGCTTAAACTCACTT
AATTGTGGCTTACCTGTTGTGCCAGCACGGCACCCGAGGCTCAGAAGCAGCTTTTCCTGCAGCGTGCATCACGGACCGGC
GAGTACAGAGGTGCGTTTCAATGTCAGAGCCGGAGTCGGGTTCTGATCTTGCCGCGATCCGAATCCGCATGGGGCGTAA
CCTGGACGGCACCCTACACCATTCAACGGCCAGAAGATGTGGCCGACTAACGGCGCTAATTTCACGTTGGTTGCCGTATT
GGTGTGCACCGACGAAGGCCGCCGAGAAGCTGCACCGCAACCTCGCTGCGTTTCTCGTAGAAAAGCCAAACGTTTTCGGT
GAAGTGGTGTCTGGGCTAACTATCTCCGGCAAGATCGACAAGCTGAGCTTATAAGGGCATCGACACCACGGAACTCATCT
TCGATGGCTACCTAGCAAGCGTTGATGACATCCGTGGCGGCCCCACTCCGGGGCGGGCTTCTTCCAGATGATGGCCAGT
ATCGAAGTCAGCCGCGTGAACGTGTCGGCAAGAACTTGTGGCGTCGGCATTCGTGCCTTCGCGCTCGCGGTGCACGACTT
GTAATTAATAGTAGTTTAGTAGCGTCACACCTTCGGTAAGCCAATCGCAGAGCACCAGACCATCGTGTTACTGCTCACCG
AAATGGTGATCAAAGTCAAAGCCATGCATCTGATGCTGGTCAACGTGGTACAGTTGAAAGATTCGGGTTGAGCAACGACT
TAGCTTCCGGTATGGCTAAATACCTTGCTAACGAATTCTGTTCCGCAGTCTACCTAGCAGAGCGTCCGGATTCACGGCGG
```

FIGURE 9

```
TTACTCTTACTTCAAGGACTACGAGACCGAGTGGTTGATGCGCTCGACGCTCCGTTCTTGCTCATCGGTGAAGGAAGCAG
CGAAATCCAGAAGTCCATCATCAGCAAGCGGATTATCGGAGTGAATTGTGTGTGACCGGTGCCTGTTCTTGACTCAGGTG
CGCGACCTCAACTGTCCGAGGACGTTGCGCGCTTTGTCCGCAAGAGGATCTTCGATGGTACTTACGTAGCAGGACAGTAG
ACCAATGGACCACGGATTAGGGGATAAACGTCACACTGGTTGTGAAGCGCTGTTTATTCTAAGTGCGCAAGGTTTGCTTG
CCCAGCAACGGCGCCGCGGCTAACATCACCGACAGCCAACTGCTGGAACTCAAAAATATCCAGGACCAGCTGGAAGATGC
TTATGTCGAAACCGGCGACGAGCGAACGGTTCCTCTCAATTTTCATCGGGGCATCAATGTTGCGATGGACTCGCTAAAAT
TTGCTCAGCTGATGTCGCAGATTACCCGCTACGCGCCTGAATTCGGTGTTCCCCATGATCGGGGACTGTCCTGACCAGTC
TGAACTGGTACCATCACCCGGTTTTGTCTGCGCTAAAGAAACACGACGGCAAGATCGCCCGGGCTACAATGTCGGAAACC
TTGCCGCCGCTGCTATTCCGTCCATTGACCACCTTGTTGCGCGTGGTGTGCTTGCTGAAGTGAGCTGTTCGTCATCTCGG
CAGCGTCGGCGCAATACGGTTGAGTTGAGGTTTTTACGGAATTCGCTAAGAATTGCTACATGCTGGGGGTTTCTATAGCG
ACGCTGCAGGCCATTTAGTATCCGTTAGCGGATATAGCAATCACCGTCCAAAGCGGCTGTAATTTGGCCCGGCGCGCAGC
TTGGTTCTTGGATAACGAACCCGACGAATAACCAGAGTTTGGCCGTTGTCGGTGTTCGCGTTCATGGCTGAGGAGGTCGT
TAGGGCGGCGACGATGTCGCGGTTAATATCCAAGGCAGCTTGGGAGTTTTGGCGTAAGCCGCCGCCACGGCCTACCTGAC
CTAGTGTACGCCGGGGGTAGCCGTTGGCGGGCAGTGATCCAGGTTTCAGCGCCCAGCAGACTGCCGAGATTGTGGCTGCC
CGTGAGAGCGCGTTACTTAACCGTACTGGTTTCCGTTACTTAACCGTACTGGTTTCAAGGAAGGAGCTTCGCTATGGATT
TCTTTCGGATTCAGCTGTCCGACTAAGACCGCCTTTCACGACGAAGCGTGGAAGTGTATCGTCGCACACATGACCGAAGA
AGTCAGGCGTCGAGACCGCTAGACGGAAGACAACTTTAATTAAAGGTCTGAATCTGACGTTCGGCACTGCGGGGTATCT
TGGCTGCGGGGTGGAAGCCAGCATCGTACGGCGGATTCAGCGGGATGCGGCGGCGTTAGATATAGTGCGCGGGCACACAT
GTCGTGGGTGGCCTGGGAACTACCGCTATGGTGGCGCTGTTTGGTGGTGAAGTAGTTCCGTTCGGTTTCGGTTGAGCTTC
ATGCCGAGGTGTTACCTGGGGTGTCGGCGGCCAAGTACGGATGTGCCTCTGCTATACTGAGCCCGAAGGCGGTTCGGATG
TTGCCATTTGCAAAACCTGAGCAGTACGTGATGTTGGTAGCTGGCTGATTAACTGGTCGAAGATGTTGGCTACCATACTG
TTGCGCACAACTGCTACTGATGCTCTCATCAGCGTTCTTGGTCACCAACACCTCATCCGGATGAAATATGACACTAGAGC
TTGATCATGTTTCTGGTGCCGCAGCACTACTTGCCGGCCATCAAAATCCAGGGCATCCGTGCCAGGGCATCCGTGCTATC
GACGGTGACCGGACCAACATCGTCTACTACAGCGACATCTGCGCCGACGACAGATATCGCCTCGGCCAGGCGTAAGTGGG
CTGGACGGTGGTATGTGAGCCAACACCAAGCCTGGCGTCCTGCAAGTCGTGGCCGCACCCGACGGCTTGCAGGACACCTC
AATCATGAGGCATCAGGTCAAGTTGGTAGCCGCAGTGGTCGACAACGCCACTTAAGCACCTGTGCCGATTCGCTACTCAA
CTAGTTTGAGCGAGCGGCTCTTAGGTAGTTTTACGTTAGGACCAAGCGGAACTGACAGAGCGGTCAGTGTCAGCCATGGA
GGAGCTGGCGCGTTGCACCTTTTGGCCGTGAGAGTTGGCCTGCTCGTAAATCATCTGGAAGTTACGACCCAGGTCGGCTA
TGAACATTTCATGGGCAGTCGAACCTTGTCCGCCCCAAAACTCAGCGGCGTCCCGCACAGTGGCTAGAATGGCCTGGTGG
GTGGTCTCCAACGCAGCCGCTTGAGCGCGGATAGCCGCTCCATGTGCGTCGATCTCCCCAAACTGGTAGTTAATGTTTCC
CATTACTTTGTCTCCTCCTGCACTGAAAGTATTGATTAGCAGCGATTTTCGCAACTAGCTGCCAGAAAGGATTTTCCTCG
AGTTCTCTTCTTGGTGCTCGTAGCGATCGGCGGCGGTACCCAGCTGGTCACGCACGTCCTGCAGCAGGGTCACTATGTGG
CGAAACGCCTGATTTATCTGCCCCATGGTGTCGTGGGAGGTCAACTGGGCGGTCCCACTCCAGCCCGCACCAGCGATGTC
CATCGAGGACATGAACATCTTGTGGGACTCGTCTCGCACGTTCTGGGCGTGCATGTCAAATTTGCGCGCCATGTCCCGCA
TCGCCTGTGGGTCGGTCATAAAATGTGCAGCTGTCATCCTTTATAATTTCCTTCCATTGATTTCGTTGCGTTGTGATGA
AACGTCAACCTCGCAGCTTTTATCCCGCTGCGGGGTTGCGGGGCATCACGAAAGCTCTTGGTTGCAGGCGTAGTGCAGTG
TTGACGCCGCCAGTACCGCTGCCTCCGCCAGGGACCATAGGTGCCATCGGTAGCCCGCCCCCCAGCAGCGGCGCCGATTC
GCTTTCGGTTGCGACGGCCACCCTGGCTGGCGACAATGCGCGCGTCGCTGCCGTAACCGGCTGGCTGGCCGTGGTCCAAG
TTTGCGGCACCCGCAACGAGCCGATCGACGCGGCCCGACCCAATTGAGCAGTCACGTGACCACCCGAGCTTGAACCCAGC
AATCCGCGGCCTGTCGACTGTACAGCACTTCCCATCGCCTTAAACGCGCTTTCTGCTGCCTTGGTCGTCGTCGGCGCCAA
GCTCTTCATCGCCGAACCCATGCCGTTGACCAATGACAAACCCGCATTGGCCATGCCCGCATGGTTGTTGATCATCGATA
AGGTCGTCGTTTATGGGCGACAAGTGTTGTGCAAAGCCCCCCACAACTGTGGTGCGGCAGCCGACGAAGAGTCAGGAACA
GCTGTTTGTGGGGTGGCGACGTCTACATTTACTTGCTGGTCCACTTGCGGTACGACAGTAGCTTCCATCCCCTCATTGAC
CGCCTGATCGAGTGCGGCTTGGCTGATTGCCTGCTCGGCCTCAACAACCTCCTCAACAACCTCCTCAACAACCTCCTCAA
CAACCTCCTCAACAACCTCCTGGGCTAACCCGACCTCATTGACCCCCAGCGGCGGCGCCGTAAATGCTTTCGTCGCCCCC
ACTGCCTCCAGCACACTAGCTTGATAGCTGGTCATTGCTGCCGCGTCTTGGATCCACATCTCGGTGTATTCGGCCTCCTT
CTCCGCGATCGCGGTGGAGTTTTGCCCGAAAATGTTGCTCATAATCAGCAGGCATGCTTGCGCGCGGTTCACGAACACCA
TCAGGGGCGGCACCGTCATTGTAAAAGCTGTTTCGTAGGCGTTCGCTGCTACCGTGAGCTGGGTTGCGGTCAGCTCGGCG
CTTGCGGCGTTCTGGGTAAGCCACTTCTCATACGGCGTGACCCGCTCTGCCAGCGCCGCTGCTGACTCACCTTCAAATGT
TGTTAGTAATGCTTCGACCGCTGACTGCAACCCCTGCGCTGCAGCAGTCAGCTCCTTAGCCAGAACAACCCATGCTGCGG
CAGCGGTCAATATCGGGCTGGAGCCCGGGCCGAGATACATCCGGGTGGAGTTGGTCTCGGGCGACAGCGCTGCGAAATCG
AACATCTCGTCGCTCCCTTATTACTCGTTGGTAGCCACTCGTGTGCAGCTAGCGACGTCCGCTATAAACTATCGTGATTG
GCAGTCTCGGTACCCGCATATGCTGACGAGCTCGTCAACAAGCTCTGGATTAGATCTCGATGATTGGTCGCGCCCTGAGA
GGCGTGCGCCTGGTACTGTCTCCCATGGCCACTGAAAAAATGTGCTAGCAAGATTGACACATCATCGGCAGCTGGGGGAG
CAATTTCAGTGGTCAGCTGGGCCGCCGCGGCGTTGCTTGCCACTGTGGCAGCACTGAGGCCCTCCAAGGTGTTAGCTGCC
GCGGTCAGGGCCTGTGGCTCTGCATTCAAGAAAAGGGGCATGCGGTTCCTCCTCGAAACTCAAACAATCCGACTACTGCA
```

FIGURE 9(continued)

```
CGGGGAAAGCTCAAGCGACCTGCTCACCTGCGCCTCCCTTCCGACTGCTTGGTGGTACGAACTGGCCTTAATGATCTCCG
TTATGCAACGTTTACAACAGGTTAAGAGTTTATAACAGGTTAAAACCACCCGAGTTGCCGCAGTTTAAGGTGCAAAGTGC
ACCCATCGACCCGGCAAAAGGTTAATTCCGTCTAAACAAATAAACACTAGGTAAACAGCACTCGAAAGATTTGTAAAATT
GGGCAACAGTATGCATGCTCCGTCACCGGTGTAATTGCCAGGTATGCTTCCCCGCCCGGAGCGATGGGTACACCACCCGC
AGCGGATCCTAGTTATGCGATATATGACGCCTAAAACGATTATCGTTACCGGTGTCAGTGGCGGCATCGGGCTGCGACGA
CTCGTCGGTTACGTCGGCGAGGCGAAACACTACTTGTTGTAGTGGTGGTGGACCGGTAGGTAAGCAGGACCGCCGTCGTG
GCCACGGAGTTGGGCACGGACTATACTTAGGTGTTGCCTTCTCCGAGCTGTGCTGGCCACATGAACTTTCCTTCGTAAGG
TCACCATCACTGACTTGAAAAGTGCGGATCGGAGTCGGCCTAACACTGGCCTATGTGCTCGTGAAGCTGGAATTTATCTT
GTTCACCAGGGAATTGCATCGGCGTTACCGTTTTGACGGGGCTCTCGGTTGCTTAAACTCATATTGTGCAGCACAGGCCG
GTGGAGCGATTTGTCGTGGCCGTAGACCAGAACTCCTAACCAGTTGGTCTAGTTGGTTACCACCACGCCCGGTGTGGATT
GGGTTCCTGGCGAAATACTATAATCGAAGTACAAGTATCGCGGAAATCAATCGCGCAGCCTACGACCTAGGTTTTGCGTG
TCTATTTTGAGATCGCACACTGGCCCAGATCACCTAACAACTCCAGCGAGTGATCACCCGTCAGAAATCGCATACGCTGA
CCCCAAAATCGATAATTCTCCTTATGATTGCACGGTTTCGCAGGTCATTGTAGGCGTTGTTGATGTTGTATAAACGTTAG
TGCTTCGTGATCATCTCGTCTAGCTGTACTTGCCTGTCTAGGGTAGATCCTGGCCAGTCGGAAGATGTCCTCCTGTGGG
TTGTGTGAACTAAAGACGTTGCCTGCGAGCATTTTGTTCATCGGGGTCAAGTCCTGAAGATCAATCTTGATTGGCCAAGT
CAGTTGCGAGGCCATGCCGGTGAGTACGGAGACCCCGCTCTTGCAGGGTAGCATTAGCGCGTAGTGGACGTTGTCGCTGA
CGATCAACAAAGGCGAGATGACAACGGCGTCAGCCATTATTCCATATGTCAGATGGCGTAACAGATTTAGTGCGTCGACC
ACTATTGCAGCTTTGTGGGTAGCGCTGAGCTGCCGTGCTAATTTTTGCTTGAATTCGCCTCGATCAACAGAGACCATCTT
TGCGGCGCCTCCGATCCGGGTGCTCTGGATCGCACTGGTTTGGATTCCTCCGGTACCGCCTGAGTGCATTCCGGGACAGT
TTGCAATTGAATCGTAGCCGGCTGTAATGGCGCACGACAGTAACGCGCTTGGTGCCAGTGGCCAGTGGTAAGTGGTGGTT
CTGTCTTCACGAGTGAATCCCTAGATACCACAGTGGTGTTTTGTGAAGGGTTTCCGACATTGGCACAGATGGCCGAGGAT
CAATCATCGGCAGTGTGATGGCGGAATGTGCCGTCGGTAGGCATGTCCGGCGTTAAGACGGTGGCCCCGATGTCACAGAT
GTACTCCATTGTGTTCGCACACCAGCGGGACTGGCAGCACACTGCGCCCAGCGATATCGTCAAGGCATCGTGCCAGCCGA
TCGTCGGGAACATGAGTGGGCAGCTCGAGGGATCGAAGCGCTTTATTGGATGCGGACAGATCCTCTTTGAGGATGTGGTC
ATCGGAGTGGCACAACCAGGAAGCAACTATCTCGACCGGGACTTCGCCGGTCCACGGCGGGTCTAGTTCACATTCCTCAC
CAGACCACGGTCCGCCGACGTCATGCAGGATAGCCGCCCGACTCCTCATGCTGCCTTTCTATACGGACGTGAAAGTGACC
AGGAAGTCTATTGGGCTATCAGGTAAGGTCAACCCGACAATTCTGGACTTTTTATCCTTTCCATGGTTGCCAACAAGGGC
CTAGATTTAGTGATGCGATCGAACAAGTTGTTCAACATCACCCGTGTGTCCAGCTGTGCTAGGCCTATCCCTAGGCACAT
GTGGCTCCCAGCCAAGGTGGTATGAGCTTGCCGTGGCCAGTGGATGTCGAAGGTGTTGGGCTCGGTCCACCGGCTTCCAT
CGCGGTTGGCCGAGCCCATGAGTATGTCGACTCCTCGTCTTGGGAAGGATGGTCTTGCCGCCTATTGCGAGTTAGGCAATT
GTAATCCGGGTGACTGAGGCCCAGTTGGGGGTTTCGGACCGCGAGCCTTCTTCGATCGCGCTTGGAATCAGGGACCGGTC
CTAATAACCATCGCCAGCTGCTCGGGGTGGATGTAGATAATCCGGCCTGAACTGGCCCACTGCTACGTCAACGAGCGTGG
TGATCAAGCCGCCTCGGAGCGCGCCAGAAGTGTTGACCATCTGCGGGCTAATCGGCGTCGTCGTCGCGAACTTGCCTTCG
CGGTGCTCGGCCGCTCGCTGATCTGGGTGAACAGCTCGCCGAGCAAGGGCGGGGATTGCTCGTCGCTGTTTCGAATGCCG
AGAGTGCCGCTAAAGGAATTATACAGTTGGCCGCGTCTATCGTGTGCTGGTTCCATTCGGTTCTCAGCCAATGTAACCGG
AGTGCCCTCACCACCGTCTGCATGATATCCCCGGCCGCGGCACCGATATCCATGCCCGGGCCCAAGACCCGTCGGTGATG
CCTTGTTCCACGATGTCGCGGATCAATTGGTAGAGCGGAGGGAGGCACGTGCGCGTATTCGCGGGGACGGGTCTCGTCCA
GATGCAGGTTATTAGAGACTCAACTACAGATTTTAGCGTGTTGTCCTGAGTGCTTGATTCTGGCTGTGTGCTGATGCTGT
CGATCATCAGTTCAGCGTGGCGGTGCTGTTTAGTCTGCGGGTCGCAGCGTGCTGCAAGTGTGCCGATTGCGCGATAATCC
TGTCTAACAGTGCTAGCAGCAATTCGTTTTTGCTACTGAAATGCTGGTAAAATGTGCACAGCGCGTCTTGGAGCGTGGGA
AGACTTCTTGCACGGTGAAGTCGGCGTGTTCCGATTTTGCTCAGTATTTCTACTGCTATCTTGATTTTACAAAGTGGTCG
GCGCGCGCTATCTTTCGACGTCATCCGCTCTGGTCGTGGGCCTCTCACTCAACTCTAAGACCGACGTTCATCTCTGGGAA
TGCGGTTACAGTATTTTGTTGCGGCCGGTAGTGCGAATCCTCGCCTCGGTAGTTGGCCCCGCTTTGCTCGATTTGTGTTG
TGGCTTAACGATTTTGAGTATTGTTTGCTTTTTCTTGGTGCGGCGGCAATGCGGTGCGCCCGCATGGTGATGCGCCAGCC
CGGACAAATGAGCTGGTGCCGACAAGAACCTACGGAACTGTACATTTGGCATTGCGGAAAATCTACGAAACCGTATTTGC
AAGCAACAGTCGACAACTGTAATATTCTCCCAGCCTTATAGTGTGGATCACGTATACAATTTTGTCAGGGAAGCTTGAAT
GACGAAGGTTTGGACGGTAGCCGAGATGGAGATGATACGTAAGAGGTATCGATGGTGACAGTGCGAGGGGTGAACAAAGG
ATTGGCGTTGAACAGTTCGTCAGTGCCAACTTTGGTTGATGCTCATGTTGTTGCGGTGCCTGCTATTACGCGCAGAGCGG
CGAGTGGCGGTTGATGCCGAGCTTTTTCCCGCAAGTGACTACGAACGTAAAGTCCATTCGACAGTTGAGGTTTATTTTTC
TTTGGCTAGTGGAGACAGGCGATGGGCGTGACGACTCCTGCTGATGTTCATAATGTTGCGTTCTCTTAAGCCACGCATCG
GCAAACGTGGTTACAGCGAAGAATGAGGTCGATCTCTTTCTTGACCTCATTGAGGAAGAGGTGGTCAGCCATATCGAGAG
GAATGCTGAGCTCCGTAATCGTGTTGCTGGGCTAGACAAGCGGAACACCAGGCTCGCTGACGGACAAGTCGAGCTTGCAC
AGCGGTGCACTGCTGTCACTCAGCGGGAACGGCAAGTTGGTGAACAAGAGGCCCGGCTGTGCCCGCAAGAAGCCGCGATC
GCCCGGCGGAGGTCCGGCTGCGTCAGCAAGAAACCGAGTTTGCCCAACGGCACGCTGTTGTGAGTGAAGGTGAATGGCA
AGTTAGCCAACAAGAGGCTTGGCTCTACGAGAGCAAGAAACTGAGATTCGTGAGCGGCAGGACCGATCAGAGTCGATCCG
TCCTTTTGCGTCAACGGTGATGCAGCTATTTACCATATGACGCAGTCCTCTCACTCTGTGCCTCAATGCATTGCGCCACA
```

FIGURE 9(continued)

```
TCTGCAGCACGTCGTTACCCATGGTTTGCTTCGCTCCTAGAGTGGGCGGACAGTAAGCGCGGTGCATGGTCGGCACCGCA
TGGAGCGGACAGCCGATTCGGGCGGTGACCGACATACTCGGTAACAGGATGGCTGAGACGGTGTGTGAGTGTATGCGCAC
GAGTACGGTTCAACCCACGCCAGTGCGTAATTGCCTAATGAGGTGGTCTCTCCATTGCAGGATCTCATGCGCGAGAACGC
CGAATTTAACCGATCCAACGGCATTCTCAAAGCTGTGGCGGCTCTCCTTGCTGCTGAGCTTGACCGGCACTAAGTGTGTT
GTGGCCTGCGGTGCGATGATCAGCTTCTTCGGGCTGCTGTCACCGTTGAGCGGTTCACCTTATGTTGTCACTGTGTGTGG
AATCTGGTCGATGAATTCCAGCGTTTTCGGAACTTTGTATCTGTCAAGCTTGCTCTTTGCTTAGTCGATCACCTGCTGCT
CTGTCGACGGCACAGCCTTGTGGTTAGCGGAGTAGTTTGCACCACCGCGTGCGCACCTTGCATCCCCAGCGCGAGTCGGC
CATTTCGACGACCACCACGTCCGGCAGATGCCTGAGTGTGTGGCAAGGGCAGACTCGACTTCGACTGGAAAGACGCTGGT
GCCGCCGGTGATGATCATGTCGGCAAGGCCGTCTACGATGTCGATGTGGAAGTGGCCATCGGATTACAGGTGGCGGATAA
TCGCCAAATTAAAGGAATCCAACGTCGGTTGACGGTAGCGGTAAAGCCCCACCCAGATAGCGGTAGTCAGTGCTCATCGG
TGCGTGCAGATACATGTCGCCATCTTCTACCGGACCCCAGCGGTCTTTGTTCGGCATCTAGAATTTGGATATCGGTATTC
GAGAAGTCGCGGCCTACGTTGCCCGGATGAGTGAGCCACTCGTCGCTGCGCAATGCCGTGAGTCCTCGGGTTCTTAGTGC
CTGTCGTAGGAGATGACAATCTGTTCGAGACTGAGTAGTTCGGCTGCCAGCTATGCAATAGCCGGTTGGCATCACGGCAGCG
CCCTGCGAGGATAAAGATTAAAGATGACGTTGGACAAGTCTCGTTTAGTCCGATGTCAGGCAGGGCTACGATACTCGCCA
GCATGGTCGGCGTGGCCGTGAAGTTGGTAATCTGATACCACTCGACTATGTTCACAACCAGTGTCGCTTCGAACTTTTCG
GGCATAACCAGATGGTCGTCTCCCATAAGAGATGAGGAGGGTGGCGAAGCCGTTGGTGTGATGTATCGGCACGGGTACC
AATGGCTTGCTGCCTGGACCACTGGCGTCCAGGTCGATCAGAACGGCTCGCTGTGCTGAGGGATGCGGAGCGACGGGGCT
AAATTAAGGATCACCTTGGTCGTGTCGGTTGATTTTCTGCTGAAAATTCCTTTTTCTGTCGGGAAATTGCTTCAGGAATT
GGGCTTTCGGACTCGCAGCTGAGAATATGCATAGGTGGGTGCATGGTAGAATAGTTTCTATTCCTGTCGCAGGGTGCGGT
TATCGCTGTCCAACATCACCGAGCGGTTGTGCTACGCAGAGGACAGTGGCTGTGACGGAATAGCGTTCATTGATCATCTC
GAGGTTCCCGGGCTCCATGATGAAAACATCTGAAATGTGATGGGAATTACGACCTTGGTAGCGGTCGGGCCTTAGCGCTG
AAGATCGGTCATCTGATGCTATGCGACGCGTTCCGGTATCCGACGGTACTCGCTAAGCACGCTATCATCCTGCCGGCTGC
GTTCGACGGCAAATTCAATTTCAGTCTAGGTTCGTGGTTGTGGTCGGCGGAGTTCGCCAGATTCGATATTATCCAGTAGG
ACCCGGTGGACCGGGTCGAGCAATTTCGGAAGCCACCTGGCGCTGACCACGCAGTATTGGGCTGACGGCGACAAGAGTCA
GCGTTCCAGACCGGCTCGTCGGATACTGCTGGTTCTGGGTGGAAGTGGTCTTCTGATGATGTAATTCTTTGTCGGGTAAT
AGGATTGGTGGAACCTCCAGGAGAATCATATTGCTCGGTTGCCCCGGCTGGCTCAGGCGACGGGGCGTACTGGATCTCGG
TGCAGCAGATAGCGGGCTTTGTTAGGTCAAGTAACTATTCGGCTGCTGTGCATGAGCTGAACACTCGGCTATTCGGCCAC
CTGGGCCCGGGACTCGTCTGTGGTGACGCCGGATGAATTGATCGCACACTTCGCGGGCTTGACGATTTATCGGGTGGAGC
TTTTCTACGTGTGGTTTGCCGATTTCGTAGTCGGTTTCGCTGCTGCGCGAGTTCGGTGAATTGGTGATCAAAGCATTCGGCCG
AGTGGAACGGCATCGAGTTTCGGTCGGGGCACGGTCTGTGGCCGAGCGAAGGGGCCGCGCTGTACCGACCGCACTCAGCG
GGATCTCCGGCAGTTCCAATGATGAATGGGTCGACGGTGTCTAATTAGGCAACAGCTTTGGTGACGTTAGACACCTGGAT
TGCGTCCACCTTGACGGGGACGTCGGTCAGCATCTCGGTTTTACCTGTTCTGGCCGTCACGATGTGGACGTCGATGCCAT
TCCGGTCGACTTCGCGCCAATGCCCGGGCGAACGTATTCATGCCGTCTTTGGATGCCGAGTAGGGAGTCCTTTTGGCTGG
TATAGGCTCGTGTGCCGCTGACGACGAGATAAACATCAACCGCGAATCCGCACGCATCGGCGCAGCGGTCATTACGAAA
CACAAATCCAGTCTGGCCGAGCCGATTGCCTGCCATTGCTCGAGTGTTTGCTTGTGCACGTATGTTTCCCAGCTTATCGG
CCTTGTGAAAGATAAGGTCGACCGATTCCAGTGTGTTTATGGCATCAGGTGATTCCGCTGTATCGGATGCTTAGGTCACG
ATATGGTGGTTCACGATCTCTACGGAGCGTAGCAAGACTTGACGTCGCTCCGCCAACATCATGTCGTACTTTAGCTCACA
TAGCCTGCGAACACATGCTTTCCTGACCCTGTCGTTGCTGTCGGTGAGCAGTGCGGTTCTGGTGTTCAAGGGCGCCGAAT
ATCTTTCGGATGCGACAATTCCTGCGGTGAAAGCGCATAGATCCGTTGTTCGTGTCCAGCTTGACGACACATTAGGTCTG
GGTGTCGGCCAGCGGTCCGGCGTGCCCGGTCGACGTCACCTTCGGTGATCGTCTCAGCGAACTTGATATGCGTGTTGAGC
CCGGCACGGCGCTTCGCCAGCGATGGGTAAGTTCCCCGCGCTGAGCTCTCGTTCGACTACTGCCGTTCATGGCTGGTCCA
CAGCGTCTCTAAGCTGCCTACTACCGCGATGTATGGTGTAGTTGCCGCGGACGATGAGATCGTGGAATCGACACCCATTT
CAGTGAAGAGCAGGCTGTCTTCGGGGTGCATAGCGATGGAATCATTGATTTTACTTAAGTTTTGGCACTAAGAATATCCT
CGCGGTCGTGCTACTGCCAGTGCGGCGACAGCAGGTTCGAGTTCCTGTAATGCCGCGCCAGGTCGGCGAGCGCG
ATTGACTTACTCTGCAGCAGTAAACCAAGCATGTAAGCGGCGCTGGTCCTGGTTGGTGTGTGCACAACGACGCTGCCACG
GTTGCCTCGCCGTAACGAGATTAGCCTCTCAGTGTCCATGATCTGCAGCGCTTCCCGAAATGAGAGCAAGCTGACGTTTA
ACGGTTCGACGAGCGCTTCCTGGCGCGGCAACAGGTTGCCGTCGATGATCTGGCAGCACAGCTCGTTCAGCTACGATTTC
GTCTATCCTCGGTGTCGACAACCGGCGACGGGCGTCGTCACCAAGTGCTAAGGCGATGATCTGATCCTCGCAACTCGATT
TAATTTAATGATGTAATTTATTACATTTAGTGATTTAATTTTTACGTGGTGACCCGCGGTTCTTGCTTTAGCTAATTTAA
CAATTATATTGTAAATAGTTGCGTGAGTTGCGGGTCCGACATCCGGTCGATCTCGCTTGACTAGTTGTGTATTGTCGAGA
TCAATGACCTGATTGTCGGCAGTTATTGCAGCAAACTGTTGGTCGACGTTGGCGCAGAGCTACGTAAAGTCAAACTGTTG
CAAGGTCATTTTGTTGTTTCGGTGGCTACCATCCTTGGATAGCCGGGATTTCCCGTTGTTCAGCTATCTCAACGTGGGCA
GGCGCAGAATGACCTGTTGGGTGGATTCCGACCTATACCGCGCCGCACTCGCTGCCCCGAACGTTATAGTGCTCACCGAA
AGCTGATCGCGGGCAGTGGCCCTGGTAATCGATCCGCAGCGGCTGCTAAGCGTCTTTCCGCAGGTGATCATAGTCATGAT
CTCCGATTTCGGCTGAATCGGTCTGTTCGCTGATCACGCGGCAACCGAGTTAATGCTGCAGAGCCTGGGCCTACTCGCCT
GCCGATCGATCGGGGAGTATGTGGGCGGCGTGTTAGGTGCACTGGCCGCGCGACGCCGCCTCGAGTATGGCGATCCGGGT
```

FIGURE 9(continued)

```
GAGAAATCGCGACCTTGTCCAAACTCGAGGCGATCACGTTGATGCAGAGTAGCAAATAGCTGCATTCCGCAGTTGCTGCG
AGTTCCTCCGGTCCGCCGCTCTCTCGAAGTACCCTACGATCGAACCGACCTGGTACGGCTAAGGTGGGATCACCATGGCC
ACGAAGTCCAGCCATGGCTGGACTTCGTGGCCATGGTCGACTGCCCTGAACTTGGCGGTATTCCGTAGCTGCGGTTTCAG
ATCAGCCGATGGGAATACCGCAACCTGATCAAGGAACGGATTGGTCCCTGAATGGCAGAATGAATCATCTAGTAGATCGT
CGGCTGGGCTAACTGTTCTGCCTACCGATCTCGGCGCAGGGGTAACGGTTACACTGCCCGAGAGACGGCCCACCTGATCG
ACCGCGGGGTGTTGGTTCGTAACCCTCTGGTTTTCACCAGCCGCTCCTGTCATGGTTGAGTCAAGGTGCGTATCTGCGGT
GCTTGTCCGCACCACAGCACGCTGTGCGGGCAAAGAGATATAGCCATGGTAAAATGTGGATCTACATGTAAAATGGCGGC
GCAAAGATTGCATCTCGAGACAGTTGTCGTTGTCGATTTGGTTACTTTTTGGGTCGGTCCGTTGCTATCCAGCTTCTCT
GCTAGCTGTGTTCGGTGCCGACGTAGTCAAGGTAGAGTCTATCCAGTGTCTCTATAGGCATTCGCTAATTGGTCGGAATG
CACACTGAAGTCGAGAACTGGTGGTAGTACGGTTAAGTATTCCATGCGATGAACTCAATTCCGTTAAGTTGGGGGAGGAT
GAATCGACATCAACCTTGATGGTACGCATCCAGTACACTATGCGGGGTTCAGTGCAGAACTTCCTCAACGGCGCTG
GGGTGCAATGCTTCCTGATCGCGGTATCGTTTTATCTGGTCGGGATTCGTGGTGAACGCCTGCAGTCCAATAGCCAGTAG
TGTGCTTGGCGGTGTTGCTGCCGGTGAAGGTGAGCACGAAGAAGAATTCTAGTTCGTTGGCGGGAAGACGGAATGGTTTT
TCGTCATTCCCGGTGATGACGGCCGATGCCAGCGTCCGCCAGATGTCGTCGGATGGGTTGCGTCGCTTTTCCGCGGTGAG
TTTGAGTGTGTACTCAAAGATGGTGCTGTGGAGATCGATTTCCTTCCGCCGGCTCAGCCAGGCTTCTGGCGATCGAGCCT
TCAGGATTCGGTCAAAGGAATCAAAAATCTGCGGCCGGTTCTTTTCCAGCATGCCGATGCTTGACCGTCACCCAGAAGTG
GTGTTGAGTGGTCACTGTAGCAAGCCGAGCGAAACCGGGTGTGAACTAGCGCCCGGAAAGCGGCCTGTTGCGTCTCAGGT
CGGCAAACAAATCATCAGAAAAACTATTTATAACATAATATCGGATATATATTTACTGTGACAGCGGTAATTGCCAGTCTCG
ATTCGTTGGAGTGTCGCACCACCACGGCGTTGATTTTCAATATTTGAAATACTAGAAATAGACTCTAGTCGTCGAACCGT
TGTCAGTGGGGTGGCCCCGTTTGCGTTCGGTTGTGTGGTATACGGAGTGCACCGTGACGTATACTGTTTTGGACTAGATT
GTTGAGTCGGGCCAAGGATGCGTCAGAACGGAAGTTCGGATCGACCGGTATTGCGTTGTCGACTTACCGGTTCTCGACGG
GTTGGTTCATCGTCGGATTTTCCTCCGACTTGACCGTCGGAAGAGGAGGATAAGCAAAGATGGCGATGATTTGTCAGGAA
TAGCGAGTACTCGATGCGGTGACTGCTCGTGCGGCCATTCTGTATGTGACCGCTCAACAAAATGGTGTATACTTTGACGG
CGATCGTGAACACTGGCTCGCCACCTTGCCGCCATTCCGGTGCTAGCTGCATCCGGAGATGGCGAGTTGTTTCGCGATCT
GCGCGCTTCTTTCAACGGCGACGATGGATAGCGATTGGTGACTGTCGATCACGAAATCACTGTCGAAGGAGTCCACGCGG
TACGATGTTGTGTCGCAGCGCATACGGCGATACGACTCTGCAGGCCACAGGGGTATTTTGGGATTAACTGAATTTACGAG
CGCCGGTGGCTGGTATTTCTCTTGCCGCAATTTTGCCTGGGATGCGGTACCAAGCCGTCATCCGCTCGGTCATGTGCGCAG
TACCGCTACGTTGCTTGACATGAAAGGGATTTAGCGCTGCTATCCATTTCAGTTAGTACCCAAGTATTGGAAGCTAGAGT
TGTCAGTCACAGAACTAGAGTTGTCTGTCACAGAAGGTGTCCACCCCGACCAGGAGTACGGTACTTGGCTCATGGCTGGC
CACCTCGACGCTGCCGAGATCGTTCAGTCATTTGCCTTTCTGAGGATATTCAATTAAGAATCGGCCCGGTGGTACCGATA
GTCGCCGGTTTCTATACGATGGTGCTATTTTATCTACAGACCGGTGATTACGGCACCTATAAAGGATTATGGCATACCGC
AGGCCACCCTGAATGCGGACATACAGCGCAATTTGGCTACCATCGTATGGCTGCCTAGGTCTTGAATATCAAAGCGGAGC
CAGAGCTGCGTCGTGGGCTGTCCACTGCGACGGTGACGAACATTACTTCCTTGTTCCTGCCAAGTTGATCTAGTCGGTAT
TAGCCGGGCGGGTTGATCCATGCAACTGGACCTGACCGTAACATCAACTCGAGCATCGACACCAGTGTGTGCGTCTATTT
ATCACGGGAAGATCGTCTGCTTCGGCCAAAAATACACCTACTCCATATGTTCAGACCGGATGGACAATGACCCGGACGTT
GCGCTGGGGTGAAGTGATCGAGTAGGTCAGCAGCCACCGATGAGCATGTAGACCGGCAATGGTTTCCGAAATATGTGTGCG
GCGTGGAAACCAGGGGAGGCTCGCGGGCTCGGTCTCAAGAATGGCGCGCGATCAATTTCGATAGCGGCGTCTACCCCAGT
ATTTGGCAGCATTCTACCGCACCAACAGTAATGCGTTGCAAGCATTCTCCGGCGTGATGCTGAGATACCCGAACCTAGCT
CATGGTATTAAGTAACCGTCTGAATGTGCCGAAGACATCCAGGTCATGGTGAGCAGCTACGTGCGATGGCCAGACGCTGT
GCGGCCCTTGGTGTACCCGATTGCGCCGGTTAGATATATGTTCGATTATCATCGGATGACTTGCTGCGCACTGCAACTGT
GGACATTCTTAGGAGAGTTTTTGGTTGCTGCTCCAGCGCATGGCCTGCCGATCGAATATGTGGACCGTGGGACGCTGTGG
GGCAATCCGGTGAGTGGCTTCGCTTGCTAAGAGCGCTCATTGGCGCTGTATCGGGATTGGGGTCTGATCGATGTGTTGGC
TACGACCGTCCCTAACGTCGCACTAGCTTACTCAGACCTGAAGATCACAGTGGATCAGGTTGTGCCGTTGTCAGTTTGAG
CTCGTTGCTATGCGGTGCGTGAGAGGTTGATGAAGGTGGTTCCCAACCAAAAGTACTAGATAGCAAAGATTCTCCACGAT
CTGCTCTCCATACTATCGGAGGACGGGTCGCCCGACAGAAATACCGGCAGCATCATGACGTTCGGATATGATTATGTCAA
TATGACAAATATGTGACTGGTGGTTTTGACGTGATTCTTTGGTGTTTCTGACATATCCTGTGACATATGTCGGTTTCTCG
GCGTGACGTCCTTAAATTCGCTACCGTGACACCGGGCCTGTTAGGTCTAGGTGTCGCTGCCGCGGCGTTGTGCGCCGTAC
CGGCATCGACGGCAGGTTCACTTGGCACCTTGTTGGACTACGCGGCCGGAGTCATCCCCGCCAGCCAGATCAGGGCCACC
GGCGCGGTGGGGGCAATCCGATACGTGTCCGATCCTCGGGGTACCTGGGCGGTTGGCAAGCGCGATTCAGGTCACTGAGGC
GCGTGACCTCATCAATAACGGGCTAAAAATTGTTTCCTGCTATCAATATGGCAAGGGCAATACCGCAGACTGGCTGGGCG
GTGCCACTGCCGGCCTCCGGCACGCCCAGCGCGGAGTGCAGTTACACACTGCCGCTGGTGGTCCCGTCAGTGCACCTATT
TACGCTTCGATCGACTCTAATCCCACGTATGAGCAGTACAAACAGCAGGTTGCTCCGTATCTGCGGTCCTGGGAATCGGT
GATCGGGCACCAGCGCACGGGCGTCTATGCTAATTCGAGGACGATCGCCTGGGCCCTGCAAGACGGCTTGGCCTCGTATT
TCTGGCAGCACAACTGGGGCTCCCCTAAGGGCTACACTCATCCGGCTGCGAATTTGCACCAGGTCGAGATTGACAGGCGC
ACCGTTGGTGGGGTTGGGGTTGACGTCAACACAATCCTCAAGCCCCAATTCGGGCAGTGGGCTTAAGCCGGTCTGGGGCT
ACTGGCGCGTTGAACGGCCTTTGCCTGACGCCGGTGCCTGTGCACTCCGGCAAACACTTGTTTTCGTTCGGTGCACGGGAC
```

```
TGTAGACTTGTAAAGATGCGTGGTGGTACGTACCTCGCCTCTGTAGCCTCACTATCAAAAATTATTTATATAAACTAGCC
TCACTGTAATTTATATAACAGTATGAAGTATTCCATAACAATCTTGCCTCGATCAATGCAGTTATAGCTACTTGACCGTA
ACCACCTACACGCAGGATGTTTGTCCGCAGCATCCGTGCTCGCGGTTTGACCCGGCGTTACTTACAACATGGCTACCCCT
ATATAGGATATAGAACTCGCTAGTAACCACTCGGCGTGCAAGAAGGGCACGTTTTTGTTACACCTTATGTTTTCTCTTAT
GAAATCCTTGTTGCAGCCGATGCAGTCTGCCGCGCGGCTCGGTCCACGGCCGGTGCACCAAACACACACCGGTCAGCTGA
CTTTCGGTCTGCGGTTTAACGTGGAATCGACCGGAAACTGACTGGGCTTCGCACGGCAGTCCAGGCGGCCTGGCGAACAG
ACACCTTATTAAAGACGCACACAGGGAGATATAGAGCGTGACGATCCACGAGCACGACCAAGTGTCCGCTGATCGCAACG
GAAATAGCCTACATGGCTCCCGTGCTCTGGCGGATCGGCTAAAGGCCGGAGAACCGTACGTCGTCGCGTTCGGTGGCCAA
GGCAGCGCCTGGCTAGAGACCCTGGAAGAACTCGTGTCCTCGGCTGGGCTCGAAGCCGACTTGGCAACGTTGGTTTGTGA
GGTCGAATTGCTACTCGAACCGGTCGCCAAAGAGCTGGTTGTGGTGCGTCCGATCGGTTTCGAGCCGCTGCAGTGGGTAC
GCGCGCTGTTGGCCGAAGACTTGGTACCGTCCGACAAGCACCTGACGTCGGCTGCGGTGTCGGTACCCGGCGTGCTGCTC
ACCCAGATCGCGGTCGGGCGCGCTCTGGCACGGCAGGGCATGGACCTTATCGCGACACCCCCGGTGGGGATTGTGGGGCA
TTCCCAGGGGGTGCTCGCTGTCGAGGCGTTGAAGGCCGGGGGGGCACGCGACGCTGAGCTATTGGCAATGGCCCAGCTGA
TTGGTGCTGCCGGAACGTTGGTGGCCCGCCGCCGCGGCATTTCCGTCCTCGGCGACCGTCCGCCGATGGTGTCGGTCACC
AACGCTGACCCCGAGCGGATTCGCCGGCTGCTCGATGAGTTCGCACAGGATGTTCGCACTGTGCTACCCCCGGTGCTGTC
CATTCGCAACGGGTGGCGTTCGGTTGTTATTACCGGCACTCCCGAACAGCTGTCGCGATTCGAGCGTTACTGCCGGCAGA
TCTCCGACAAGGAGGAGGAGGATCGCAGGAAAAAGATCCGCGGTGGTGATATTTTTGCGCCGGTCTTCGATCCGGTGCAG
GTAGAGATAGGCTTCCACACGCCACATCTGGCCGACGGTATTGGCATCGTCGGAGGCTGGGCCGAGAAAGTCGGCCTCGA
TGTCACGTTGGCCCGGGAACTGACTGAGGCCATCCTGGTGCGCGGCGTCGACTGGGTGCGCGAGATTACCCGGGTACATG
GTGCTGGCGTTCGGTGGATTATCGATCTGGGTCCTGGCGACATTCTGACCCGGCTGACTGCGCCGGTGATTCGCGGCCTC
GGTGTGGGCATTGTGCCCGTTGCAAATCGAGGTGGTCAGCGCACCCTCTTCACCGTCGGGGCCGTTCCTGAGGTGGTTCG
CGCTTGGTTGAGCTACGCCCCAACCGTAGTCCAACTTCCCGACGGCAGGATCAAGCTCTCGACGAAGTTTACCCGGCTGA
CTGGGCGTTCGCCGATTCTGCTCGCGGGCATGACCCCGACCACCGTCGATGCCAACATTGTGGCTGCTGCGGCCAACGCC
GGGCACTGGGCCGAACTGGCCGGTGGTGGGCAGGTCACGGAAGAAATTTTCGCCAACCGCGTCGAGCAACTGTCCGGACT
GCTCGAGCCTGGACGCACCTATCAGTTCAACGCGTTGTTTCTTGACCCGTACCTGTGGAAGCTGCAAGTTGGCGGCAAGC
GGTTGGTGCAGAAAGCCCGGCAGTCTGGCGCAGCGATCGACGGTGTGGTGATAAGCGGCGGTATTTTAGATTTGGAAGAT
GCCGTCGAGTTGATCGAGGAACTGGGTGGCATCGGCATCAGCTATGTCGTGTTCAAACCCGGCACCATTGAGCAGATACG
CTCGGTGATTCGTATCGCGACCGAGATGTCCACCAAGCCGGTGATCATGCATGTCGAGGGTGGGCGTGCAGGCGGTCATC
ATTCCTGGGAAGACCTCGATGACCTGCTACTTGCCACCTATTCGGAGTTGCGCTCACATGCCAACATTACTGTTTGCGTC
GGCGGTGGCATTGGCACTCCCGAAAAGGCGGCGGAGTACTTGTCCGGACGTTGGGCGCAAGCGTACGGCTTCCCGTTGAT
GCCGATCGACGGTATCCTGGTCGGCACCGCGGCGATGGCTACCAAGGAGGCCACTACCTCGCCATCGGTTAAGCGGATGC
TAGTCGAAACGCAAGGGACCGACCAGTGGATCGGCTCCGGAAAGGCCCAGGGCGGCATGGCTTCCAGCCGTAGCCAGCTC
GGTGCCGACATCCACGAGATTGACAACGCTGCCTCGCGTTGTGGTCGACTACTTGACGAGGTCGCTGGCGATGCTGAGGC
GGTCGCAGAACGTCGTGACGAGATCATCGCGGCGATGGCCAACACCGCTAAACCTTATTTTGGCGACGTTTCAGAGATGA
CCTACCTGCAGTGGTTGCAGCGCTACGTTGAGTTGACGATCGGCGAGGGTAACTCGACCGCCGACACTGCGTCACCGGGC
AGCCCATGGCTGGCCGATACCTGGCGTGACCGGTTCCAGAAAATGTTGCAAAGAGCTGAATCGCGTTTGCATCCAAGTGA
TTTCGGTCTGATTAAGACAATTTTTACCGATCCTGTGTTACTAGAGAAACCCAACCAGGCTATCGCCGCTCTGCTGAAGT
ACTACCAGACGCCGAAACCGTCCAGCTGCACCCGGCGGATGCGCCTTTCTTCGTCATGCTATGCCAGATGCTGGGCAAG
CCGGTCAACTTCGTGCCGGTCATCGACAAGGATGTGCGGCGTTGGTGGCGTAGTGACTCGCTGTGGCAGGCGCATGATGC
TCGCTATGACGCCGACCAGGTGTGCATCATCCCCGGCATTGCAGCGGTGGCCGGTATTACACAGATGGACGAACCCGTTG
GTGAGTTGCTGGACCGCTTCGAACAGGCCGCCATCGACGAGGTACTCGCCGGCGGAGCGGAGCCGGTGGTGGTTATGTCG
CGCCGGTTGGGCCGTGCCGATGTGGCCGGACCTCTGGCCGTGGTGCTTGACGCACCCGATGTGCTGTGGGCCGGGCGCAT
CGCTACCAACCCGGTTCATCGGATCGCCGATCGCGAATGAGTGGCAGGTTAATGGAAACCTCAGTGCGACACACTCATCCA
CCGGTGCCCAGTTGCAGGTAAAGTCCGAAGACCAGCAGGTAGTTCTCAGCGTCCCGGTGTCGAACGGTTGGATCGACATC
CCGTTTACGTTGCCTACCAACACCGTTGACGGCGGTGCCTTGCTGGTATCCACCGAGGATGCCACCAGTGCCATGCGCGC
AGTGCTGGCAATCGTCGCTGGTGTTGACGGGCCGGAGTTGCTGTCCCGGTTAAAGACGGAACTGCTATAGTCACAGTGG
ACTGGAATCCTGAGCGGGTTGCTGATCACACCGGGGTCACGGCCACCTTCCGGGAGCCGCTGGCTCCCAGTCTCGCCACT
GTGCCCGACGCATTGGTCGGTGCATGCTGGCCCGCGGTTTTCTCGGCCATCGGCTCCGCAGTTACCGAAGCCGGTGTTTT
GGTGGTGGAGGGCCTGCTGAATCTACTGCACCTGGACCACGCTGTCTGTGTTGTTGGCAAGTTGCCAACAGTTCCAGCCC
AATTGACAGTAACCGCAACGGTTTCTTTGGCCATCGATACAGACATGGGCCGTGTCGTGCCCGTCTCGGTGACCATTAGA
GACACAACCGGAGCCGACGGCGCTGTGCTTGCCACTCTCGAGGAGCGGTTTGTGATCCTCGGACGCACCGGCACCGCGGA
ACTCACCGGCCCGGTTCGGGCTGGTGGAGCAATATCTGAGAACGCGACCGACCACTCCGCGCCGACGGCGTCGTGACGTCA
CCCTTACCGCACCGATTGATATGCGTCCGTTCGCAGTGGTGTCCGGTGACCACAATCCATTCACACCGACCGGACTGCT
GCGCTGTTGGCAGGCTTGGAATCGCCGATCGTGCACGGCATGTGGTTGTCGGCTGCAGCTCAGCACGTGGTAATGGCTAC
CGACGGACAAGCTCGACCGGCGGCGCGATTGATCGGGTGGACTGCACGATTCCTGGGTATGGCCCATCCTGGCGACAAGG
TCGACTTTCGTGTCGACCGCATTGGAATCGACCAGGGAGCAGAGATTTTAGAGGTTAGCGCGCGCATCAGTTCGGGTCTG
```

FIGURE 9(continued)

```
GTGATGTCGGCTACCGCACGGCTGGCCGCGCCCAAGACTGTCTACGCGTTCCCCGGCCAGGGTATCCAGCATAAAGGTAT
GGGCATGGATGTTCGGGCTCGTTCCAAGGCGGCCCGCAGGGTGTGGGACGATGCTGACAAATTTACTCGTAGCGGGCTTG
GGTTTTCGGTCCTGCACGTGGTGCGTGACAACCCGACCAATATCACCGCCAACGGTGTACATTACCACCATCCCGATGGG
GTGTTGTACCTCACACAGTTCACCCAAGTTGCGATGGCTACGGTGGCGGTCGCGCAGGTTGCTGAGATGCGTGAACAGGG
TGCTTTTGTCGAAGGTGCTATCGCCTGCGGCCATTCCGTCGGCGAATATACGGCATTGGCCTGTGTCATGGGAGTCTATG
AGCTAGAAGCCTTGCTAGAGACTGTGTTTCACCGCGGGTCGAAGATGCACGACATCGTGTTGCGCGACGAACTGGGCCGT
TCTAACTACCGGTTGGCGGCGATCCGACCCTCGCAGATCGGCCTGCCCGATGATGAGGTTCCCGCGTTTGTCAGAGGAAT
CGCCGAAAGCACTGGTGAATTCCTGGAGATCGTGAACTTCAACCTGCGTGGCTCGCAGTACGCGATTGCCGGCACGGTCC
ACGGCCTGGAAGCATTGGAAGCCGAAGTGGAGCGGCGCCGTGAGCTCACCGGCGGTCGGCGCTCATTCATCTTGGTGCCT
GGCATCGACGTGCCATTCCACTCGCGGGTGCTACGGGTCGGCGTGGCAGAATTCCGCCGTTCGCTGGACCGCGTCCTGCC
GCAGGATCAAGATCCCGACTGGATCATTGGGCGCTACATCCCCAACCTAGTGCCACGGCCGTTCACACTGGCTCGCGACT
TCATCCAGGAGATCCGGGATCTGGTACCTGCCGAGCCACTCGACGATATCCTCGCCGACTATGATACCTGGCGCCGTGAG
CGCCCGAGTGAGATGGCGCGGCGGGTGTTAATCGAGCTGTTGGCTTGGCAATTCGCCAGCCCCGTGCGCTGGATCGAAAC
GCAGGATCTGTTGTTCACCGAAGAGGCCGCTGGCGGCCTCGGCGTGGAGCGGTTCGTCGAGATCGGTGTGAAGTCGGCGC
CGACCGTTGCTGGGCTCGCTACCGATACCCTTAAACTTCCTGAATATTCCCACAACACAGTCGAAGTGCTCAACGTCGAG
CGTGACGCCGCGGTGCTGTTCGCCACTGACACCGATCCCGAGCTAGAGCCGGAGCCAGAAAACGTATCGGACGCTTCCGC
CGCTTTACCGGCAGAAAGCGCGTTAGCGCTGGGAACTGTTGCGCCTGCTCCGGTGGTGCCGTCGGGTCCTCGGCCGGAGG
ACATTTCGTTCGGCGCCGCCGACGCTACATTGGCGTTGATCGCGCTGTCGGCCAAGATGCGCCTCGACCAGATTGAGGAG
ATGGACTCGATCGAGTCCATCACTGATGGCGCGTCGTCGCGGCGTAACCAGCTGCTGGTAGACTTGGGTTCTGAGTTGAG
CCTGGGCGCCATCGATGGCGTCGCCGAGGCGGATCTAGCCGGGCTGCGGTCGCAGGTGACTAAGTTAGCGCGCACCTATA
AGCCTTACGGTCCAGTGCTTTCTGAATTGATTAATGATCAGCTGCGCTCGGCTCTAGGGCCCTCGGGCAAGCGGCCCGGC
GTCATCGCCGAGCGGGTCAAGAAGATTTGGGAGCTCGGCGATGGTTGGGTTAAGCACGTAACGGTCGAGATTGCGCTGGG
AACTCGTGAGGGCACCAGTGTTCGTGGGGGACCCCTGGGCAACCTGAACGAGGGTGCGTTGGCCGATGTCGACTCCGTTG
ACAAGGCCGTTGACGCGGCGGTCGCTTCGGTCGCTGCGCGGCATGGCGTTGTGGTGGCCCTGCCGTCCGCGGGCAGTGGA
GGAAGTGCGACCGTCGACGTTGCAGCATTGAGCGAATTCACCGATCAGATCACCGGACACGACGGCGTGCTCGCTTCGGC
GGCCCGTTTGGTATTGGGTCAGCTGGGTCTGGATGGACCCGTTACTGCGGCTCCAGCTACCACCGACACCGGGCTCATCG
ATTTGGTTACTGCTGAATTGAGTACGGACTGGCCCCGTTTGGTGGCTCCGGTGTTCGACGTCAAGAAGGCCGTTGTTTTC
GACGACCGCTGGGCTAGTGCCCGTGAGGATTTGGTCAGGTTGTGGCTGAATGACGAGGGTGAGATTGAAGCCCAGTGGTC
GCATCTGTCGGAAAGGTTCGAGGGCGCCGGCCACGTCGTTGCTACCCAGGCCACCTGGTGGCAGGGTAAGTCGTTGGCCG
CGGGTCGCCAGATCCACGCGTCGCTGTACGGACGGATCGCTGCCGGTGCCCAGAACCCGGATCGAGGTCTCTACAGCAGT
GAAATCGCCGTCGTTACAGGAGCTTCAAAGGGTTCGATCGCCGCCTCGGTTGCAGCACGACTGCTCGATGGCGGTGCCAC
TGTGATAGCGACAACGTCGAAGCTCGACGAGGAAAGGATAACGTTCTACCGTGCGTTGTACCGTGACCATGCTCGGTACG
GCGCCGCGTTGTGGGTGGTCGCGGCCAACATGGCATCCTATTCTGACATTGATGCACTGGTTAATGGATTGGCAACGAA
CAGACAGAAAGCCTTGGGCCACAGTCGATTCACATCAAGGATGCGCAGACACCGACGCTGCTGTTCCCGTTTGCAGCGCC
GCGTGTGATCGGTGACTTGTCGGAGGCCGGTGCACGCTCCGAGATAGAGATGAAAGTGCTGTTGTGGGCAGTGCAGCGAC
TGATTGTTGGTCTGTCGAAGATCGGCACTGAGCGCGATGTCGCGTCGCGGCTGCACGTGGTGTTGCCCGGCTCACCCAAC
CGCGGCATGTTCGGTGGCGATGGGGCTTACGGCGAAGCTAAGTCGGCTTTGGACGCCGTGGTGAGTCGTTGGCACGCCGA
GTCTTCGTGGGCGGCGCGGGTCAGTCTGGCACATGCGCTGATTGGCTGGACTCGCGGCACGGGGCTGATGGGGCACAACG
ACGTTATCGTCAGTGCTGTCGAAGAGGCAGGCGTTACCACGTACTCCACCGATGAGATGGCCGCAATGTTGTTGGACTTG
TGCAATGCGGAGTCCAAGGTGGCTGCGGCCGGCACGCCGATC
```

FIGURE 9(continued)

```
GATCCATCGGGACCGGGGAGGGCCGAACGGTGGGCACCCACACCATACGACTGAAGAATTCTTCCGCTCTTGTATTCGAG
CACTCCGGCCTGTTCAATCGCATAAACCGCAACACCGGACAGTATCACTACCTGCCGAATACCGGCGAAGACGAAGTACT
CGTCGAAAAAATGGGTGCACACATGCCGGCAGTCACAGCTAATCCAAGGCACCCGGTGCTCGCGCTCATCGCCGTCCAGC
CAGGCCGGGTTCGCGTCGGCTAGCCGGGCCCCACCACTCGACCGGCGAACGACACAAGCATGGGAGCCGAACAGGTGACG
AATCAGTGAATTAGTGCCAAGCACTTGCACCACCCGTGAGGCAGCAGCACCCCCAACGCGCTGGCGCCCACGCTTTCGGTAAT
GACCCAGTTACCACCAGTGCTACACAACACCGGGAAGCCGTGGATACTAGCCTTGTCGTGATCACACTACGAGAATAAGA
ATTTAAGTCAAAGCTCACTATAGTCTATAGTATAGTATGCCATACTTAAACTATATTGAGTCTCTTAGCCCACCAGCTAG
GCGTTGGACCGCTAGAGCCGCTAGAGTGCGCCGCTTAGCTGGTGGGTTAACGTCTCGGTGAGAGCCTCCATCTCTTCAGG
GCTGAGCAAATAGCCTGCATACAGCCCCCACACCGCACAACACTACTAGCAAGGTCTCGGTCAAGGGATACGCATCGATG
TAGCTGGCAAGTTCGCCACACTCGATGGCATCCTTGACAGCCCAGCTCAGAAAATCTCGGCTAAGCCGTACGGCATCGTT
TTCGGTGCAACTCAATTCTGGATGTCGCTGTGATTCCAGCACGTTGGTGACGAGGAACGCCGACACGAACGGAGCGGACG
GATTAGCGGAATGCGCTTGCATCGCAAGGTTGATGAATACCGACACCGGCCTAAGCAGGGTCGTCTCCCGCTTAGCCTGA
TCGATGCTGGTCGCAATAACCAATTGGTTGGTTTGGTCCACCACCTCGCTGTACAATGCCCGCTTACTGGAAAATGTAAT
GATTGATCGCGGGACAAGTCAGGTCAGCACGGACAGCAATCGCCTGAAAAGTCGCCCCGTAATAACCACGTTCACTGAGA
CACTTCGCGAGCGACGCGCACAATGCGCTTGCGTGTCTCGTCGGCTTTCGCCGCTGGGGGACGGCCTGGATTGCGACTCA
CCCTAGACGGCCTTGCTAAAGTGTGCCACCACCGCCGCGATGCGGCATCACACGTTAGCTGGAATGTTGCCGAACTTGCC
GGACCGGTAGTCGTCAAGCACTTCGATCAATTCAGCACAAGAGTTGATCACAAATGGTTCGCAGTGAAATATCAACTCGC
GAATCGGCAGTGCGACCAGCATCAGTACGTCGTACGATTTGGTCTGCCTTAACTCCGACGGTGATTCGATCGGCCGGGCC
CGGGAACGGCCAACCGACCCTGGTTAACCAGATGAGCGACCGGGACGAGGCACCAGCTACCGAACAACACATACACCAAA
TGCACTACAGTCGGGCCACCATAGCAATGTTGGCGTAACCTCCATTTTAGATCGTGGCGTGCATGCAGTGCGACCAGCGT
GTGGGTAACACCAAGGCCGCGGCGGACTTCGAATTCCACGACAACATAACGGACCAGCGCACCGCCGTCTCCCCGTCGGG
GAGCAGCGTAACATTGCTGGTTTCGATGACCTGATACCGACAGAACGTGAACTTGTCTTTGCTGGACAAACTCACCCCAG
AGCTGAACGCCGTGGATGATGGCGGGTCCAGCATCCACGGCGTCGCGCCGGCCGTGATAAGATCGGCCCACCATGAGAAT
CCTAATGCGTGAACGTGCCGTCGATCACATTAAGTGACCGTTTCGAAGCATCGGCACAGATGCCAATCGGTACCGGGAAG
TGGCCGGCTGGTACTCCACTTCACCTAATGGATCCATATGTCCAGTTCCGCGCTGCTGACCCCGGCTAACGCCCGGAACA
CTGGAAAAGCCCTTAACCTTCATAGCCCAGCCCTCGCGGGCCGATGGTGATCGATCGGATTGGCAGCTCGGCGTCAGCGG
ACCCGGCCGAGTAGATGTCCAGCTACATCACTATGTAGCTGGACATCTTTACCTCTTCACCTAGCTTATTATGGTTAGGT
ACTCAGCACCCCGTTCCGTGCGATACCACCGACGGTGACACCAAGGGTGTATACCACGCCGGTATAGCGATTGTCTGCA
CCTTGCTCCAGCCGCGTGGGTCGTTGAGCATTGATACGTCAGGCATCAGGGTGACCACGGCTGGGGCACTGCTGTGGTCA
TTGATCTAGGTTAAACTCGCGCCAGAAGCCACCGATCACAGCACTGACGAAGCCATTCAGGCAATACACGGCATCTGCAG
CCGGAGTGGTAATTGGTCAAGATGGTGGTCAACGCACTCACCATTGGCTCCGGGGTTCAGCTGGACGCGAAGACCCCAC
GGCCCCAATCTCCGCTGGCTTCGCTTTGTTGCTGACACGACGGCTCGGCCTGTCCGACAAGAACGGCCGGATCGCGGCAG
CGTTGGGCATTAGCACAATCTTCACAGCACCGCTAGACGATGGGAGTATGGCGGTATCGATCGTCTACCGCGACAACTGC
GACCACCGCCAGCTGATCCCGGGGTTAATTACCCCTGGGAGAGCCTACGCAGTGCATGGATCGGTGTTGGATGTTACCCT
TCACTGGTCAACTACATCAACGCCGTGTATCGCTTCGAAAAAGCGTGACCGATGAGAAAGTTTGTGGTGATAAAATTTGG
CTGCGACAGCAGCCGCTACCTGTACGACTTAATTACACGGTCGGTCGTAATCACTTAGCGACCTTCGCGGCGGGCAGGT
ACTCAAACCCACCCTGGGTGGACTCCTGGGACTGCTAGATCCCGGGTCTTGGACAATAGTTATGACTGGACACCGCTCGG
AGTCACTAATGGCGGTCCCGTTTGTTGGCTTGTAGCGGTACTCGCGATCACTAAAGATCGTCGGCACATCAGTGTCAATC
AGCACTAGCAGCTCAGGATAGTTGTGCGGACTACTCCGAGTACTGGATGCCCCGGGTATAGCGATTTCTGCTCGAGTAGA
TCTTTCAACGCATAGTTAGACAGCTTGCCGAGCGCCGCTGGCAAATCATGATCATGGTCGCGGAGATGACCAACGCATTC
TCGAAGCAGTGCAGCCACCTAAACCAGCCGTGGTAGGCAAGCGAAGGCAGCACTGAACCGACCAGTTAAGGCTGAATTGC
CCAACCTCAACGGGCCGTTACCAGGGAACGTAACAATGCGTGCACCCTTCACCTTATGATTCCAAACTCCAGCAGATCAC
AGATTCATCGTACGTTGGACCGCAAACTATTTCCCTAGACAGGATGGCAATGTGACGACGCCGTTTGACGACATTCAGGT
CGAGCTGACGTGAACCGTGCCTACAGTGTCTATGTGACGTATAGTGATCGAGACTAAGGTTTCGCGGTGCTCAGCGATGA
CTCCACCTGCTGGAGCAGCGTCACCCGAGATTCGTTCGACAAGCAGACTCTCCGGCATCGCCATCGAGCGAAGCAAACAG
ATCTTCGAGATCAACATCGAACGATGCGCTGCACCAATTAAGGCGACGCCGGGATCGTTGAGGGGGCAGGCCGACAGCAT
CACTCCCGGCGTGCGGTACGACAGCACCTGCATTTTCAGCTTAGACACCCGTGACGGACTTGTGTCGATCCGCGAATACA
GCGGCACCGGCAACGGTCACTCCGCTGTAGTAGCTGGCGTCAATTTTGAACGGGCAGTAAGTTAGCTGGTGTCGGTGTGG
AACTAAGCCGGACGGTGACGACGATTGAGAGCTTAACGCTTCCCAAGTCACACGGGCAGGGCCAGTCCGAACTCATAGCG
ATGGTATTGCGCCATCGTCCACAGTTCCGGGACCGGCCTACCTGGAGTTGAGAGCTTACCCGACCACCGACATGCAGGCG
ACACCAGGTTGAATATGTCGCTGTCAAACACCGATTCGACGCACCAAAAGGCGCGACGCCGAAAAAGCGTACACAATTTC
AGCGGGACTGACGATCCACCAGCAAAGTTTGGCGCAGGTTGGACGAACCACCGCATTGATCACCTGGGAGCGAATTCCGA
AAGTGTTGAATACGTCGAACCGCATAGCCGGCTCACCGGAAAACGCTCGGTGATGTAGCGTAGCAACGCCAATCGTTCAT
CTTTCGACAAGTACACCATAATACCCTCAGCAATGAACAAGGCCAGAGGCGCGGATGAGTTATCACCGCCAGCCAGAACA
AAATCGGTCACCGACGTCGGAAACATCCAATAATTCGTGCAAACGAGACATAGCTGTCGGCACAACGCGATGACTTCAGG
AGAGTGGATATCTTACCAGCACACACTCGCAGGGAATTCCAGTCTCTCACGTCGAGCAACCAGACCACAACCCGTGTACA
```

FIGURE 10

```
GCACTACCGCTTCATCGTGCACAGCTAAGTATGGAGCTGGAGCGTCTAATTGTCGAAGCCAGCGGGGCTAACAACGACTT
ACGGGGTCCGTAGCACGTTTGCTTATAAACGTTGTCGACCTACGCATAGTCAATACAAGCCACAGCAACCCTCGTGTAAT
GGTCAGCCAGTATCAAGTGAGGAACATCGGTGTCGAACACTTTGGCGGATCCATCGACATGCACCCATTCCATGTGCACG
AACCTATTCCGATGGGGCAGCGGCGATCTTTCGAGTCGTTCCGCATCGCGACCCAGAACTGAACATCCGCACGGATCGAT
TCCTCGACCAGGAACGATTCCCAACTCAACTCCCGTACGACCCTGCCGTGATCGATTTCTGATTCGGTGCACGTCGTCCG
CACCGACGCTAAGCTGAGGTTCGACATCTTTGCCGGTGAGCCGAGCTCGCAAGCTTCCCGGTAACGCCCGGACCGTTACA
ATATCGGGGTCGAGATAGGACCGTTGCGGCTGCGGCACGCCGGCTTAATCGGCCGCAATACTCACGACTTGCTGCAACGG
AATCATCCAAATTCAGATACATATCGCTAGACGAGAATTTGCAGCCGATGCCGTTCATCAAAAACGGCAGCTTGCCGAAA
ACCACGCAGGAAATGAAAGCTTCAGGGTGGGCATGGCCACTACCGTACGTCGTCGAGAAGCACATTGCGACGACGAGCAG
GCCGAACGCGGCCACGTAACACATCATCAAATCCTCAGCAGGCAAACTATATGGGACTTAGGGCATCAGGGCGGTGGTGA
CGATCACATTGGCCCCGATTGGCACTTACCCACAGCGCCGGCCCACCATTGCGTAGACACTGGTGAAGAGAATCTGCACA
AGCCAGGCTGCTGAGGCGCGACCAAAGATATTACGACGCCCTTCACACACCCACTCATGCGAAACAATAGCTACTTGCCG
CGTAACCACGCGGCAGTGTCGACTACCCAGCAGTACACGTCACCCGCAGCAGTCCATCACCTCGCGTAGGGTGGCGACGT
CGAAACAGGCGCAGGGAAACCGTGTGGAGTACAAGACACCGATAACACAAGTGCTGGAGGTGAGTCAGACCATCGCCAAC
ACATCGCGTTTCACAGGTGTAACGTTGGTAACAAACTTGTGTATCACATACGAGCTGAGGAAACCGTTGGCGACGATGAC
CAATGCGAGTGTGGTGCTCACCGATTCCTCACTCCCCATAGCTGTTCTCAGCGCATACAGTAACACTGCCGCGACGTTAT
AGCGTCCCCAGGGCTTGCTTACAGCACAACTACATCTACACCCCCGCCCCGCAAGAAACTCAGCGGGTTAGGGTTTTAGT
AAGTAAGATAGTTCTGTTGACGACACCACTGACAGACGGCGACGTAAGTAATGATGGATGTATTGGTCGAGTAATGATGG
ATGTATTGGTCGCGGTGGGTGTAATCCCGTCACTAAAGATCGGACACTGGGTTGTCTGGTTTGCAGATGATGCGCTCGGT
AGGTTCATCGGACTGATCACAACGACGAAAACGTGATCATGTGGCTCACGGGGAAGGGCTTAATCGTCTGCTCAATCCAA
GCACGCACCTGATCGTGTTCGGGCATGGCGCACACCGCATGCTGGATCTACGTGACGTCCAGTGTCTACTGAGCGATCTA
GGAGTACCATACTAATGTTTCAACGGCCCGAGCGACCGGTCTCCTGGAAATTCTCAAATGCGACGGACAGCTCGCAACGG
AAGAACAGCCAGGTAGTCACGCAAGCACCCGGAAAATGTTGGCTAGGCGGATTTTCTTGGCGCAATTCGATCGCACATCC
GGTTTCCGAATGCCGTTACATCTCATTCGTCTGAGTGTAACCTGGCTAGGGACCGTCATCGGCCCCAGGCACCATCGCTG
GTAAAGCCAACAGGGAGAGTCAATGGCAAGGACAAACACCCGAAAAGCGATCCTCGCCGGCGGCTGTTTCGGGGAATCC
AAAATTTGTTCCGCCGACAACCCGGTGTGATATCGACCCGGGTTGGCTATACTGGCGGCGGCACACCCAACGCGACATAC
CGTAATCACGGCATGCACGCCGAGGCGGTCGAAATCATCTATGACCCAGCGATCACTGATTATCGCACACTATTGGAATT
TTTCTTCCAAATCCACGATCCGACAACACGAAATCGGCAAGGAAACGACCAGGGTACCAGCTACCGGTCGGCCATCTTCT
ACCTCGACGACGAACAAAAGAAAGTTGCGCTGGACACCATAGCCGCCGTCGAGGCTTCCAGCCTATGGCCTGGCAAAGTA
GTGACCGAGGTCAGCCTCGCTGAGGACTTCTGGGAGGCCGAGCCTGAGCACCAGGATTACCTGCAGCACTATCCCAACGG
GTACACCTGCCACTTCGTTCGTCCCAACTGGAAGTTGCCACGACGAGCCCCGCAGACGCAAAAGCCGACAGCTGATCGG
CTAGGACCCCAGGCGGTCAGCGTTGACGCAGGATCCACTCGCCCGCCATTTCTTGGGGTGTAGACTACCCGCGCAAGTG
CTATCGTTCACCAGGCGCCGTGGTGGTATCTATAATCCAGTAGCGCAACACCATTTTAAGCACCACATTCATTCCATCTC
CATCTTGGCAAATGGACACACATCGGCTCGTGCCGCCGCTGAACGGGGATCCACGCGAAGGAGGATGGCTTGTGTTCGAC
GTACCGCCGCGGATCGCAGTGCTCCGAGACCACGGACAGCCAGTAAATTTGCGCAATGCTAATCAAGATCGAATCCTCT
CGGGGAATGGCCCATTCGCTGAGGTGGTACACGGACGAATAGACGCGACGAGCGGCGAAATCGATGACCGTCCTGGTCCA
CTGGACTCCCAGGTATAGTCGCCTGACGCAGCGCGGGGCAGGATCATCACCTGGCATTGTCGCCCCATCGATGATGGA
TCGGCCAGCACCCCCAGGTGCTGGCTCAACAATTAGAAGAGGCCGACTAGAGTGGCCGCGGTGGGATGGAGCCGGCGCAG
TTCGTCTAGTTCGGAGCCGAAACCTGCGCGCATGATGACATTGATCGTGATCCGATTAATCAAACGGCAGTGTGGCAAAA
GGCTAGCCTTCAGGCCAGTTCTAAGCCCCCACAGCGGCTCTGCTTCGAAGATACGCACGTGATTCTTCATGCACGTGCCG
TGCAAACGGCGGCGAAGCCGCTCTGCCGTAGATCGGGAGTCGAGCATGAAAATGTCGTGATTGCAGCGCGCCTGGCGTTC
GACGGTCCATCGCGGTAACACGGCAACGCCAAGGAACTTCAACACCTTTGGGAGCCGGTAAGCAGGGAAACCTAAATTAA
AAACCGTAGCGATCGCTAAGATCAGCACCCGAATTAGGGACGGCGCCATACTGTACCGGCCCATTGGCCCTAACACGGTG
TCTTGCGGAACCAAGCCCGACAGAGCCTCAAATGCACCGAAAAGAGCTCCGTAAATGACTTCAACAACAATTTCACGTGC
GACGCGGTTCTGTGCTACACCAAACCCTTTTCGGTATCAGCTGCCAGACAACCTAGCCACCTCGATCGGCTAGCGTTACT
GCCGAGCGAGCACAGCACACAGCATAGTCCGACGCTCGAACCCCTTGGTTGCACGACATTGCCGAACTCGCTTAGGTAGT
ATAACGGGCGCCGAATCCAATTTCGCCCGGAATCGCCCTGTCAACACCGAAACATGATTAGTCAGCACATGGCCGCACCA
CCGCGGTGGAGGACTTCTGTCCACCCACTACAGAAGCATATCTCGGGCTGCAGCGAATGCCGCGACTAGGTGGTAGATGA
ACGCACTGGTGAAATACGGGACATGAGATGATGGCCTGGCTGCTTGCTGATCGGCGGGATGCGTGGGCAACGGCGGTGCA
TGACTAAACCTAGCTCCGCATCGTCAACGCCCACAAAACACTTGCAGTGCGTAGATTTGTTGGATGTCGCCATGCTGGAT
ATAGCACCGTCACTATTGCAGTCCATGAACAGCTTTCACCGCAAAATTTGGGCAGCTTCACCATCGTTGGCATCGGTACC
GAATCGATGGACGACCGCGCCCTAATTACACTTCATGATTGAGGGCTGGCAGCCGTCCTACTCGGTACCACCACCTGGC
GCAGTCTCGTCGTGGCCGAGCTGGTGTGGACCGATGTGCCCTGCGACCGGGTCGATTGTTCGTGGTCGCGGCGGTACGGT
CCCCTATATGTATGTAGAAATATGTATGTAGAAATCTTCCTCTATAGCGGCCAAGGCCCTAACAAAACAACCGGGCTAGC
GGCATTCTGAACAGTTCCACTCTCACAGTTTTACCAAACAGTTTCCGATGATCCTGGAAGCAGATCGCATATTGTTGAGA
ACTATGAGGTTGTAAGGAATACGTCATTAAGGGTGACGGTACGAAGATGTCGTGAACGGATGATGTCGATGAGCTGCGGG
```

FIGURE 10(continued)

```
TAGACGTGGGTAACCGGTAGGTGGTTGAGATGTCCGATCACGATGGCTTGCGGAGTGAAATACTGGTCAGCCATCTTCAC
GATGTAATCCTCGGTGATCAGCGTGGAATCCGACAGCGAACCCGACCATAAGGTTGGAACGGTGTAGCCGAGATCGACCG
CCACCGCATCAACAGTGGCGTTGTGCTTGGCATACGGTGGACGCCAGTACGGTTGCGCGGCGATACCGTAGTTCTTCTTC
AGGAAGTCGTCGTTGCGGTTAAGCTGTGTGGCTATCTCGCTTTTAGTCATTGCTGTCAGATCCGGGTGAGACCAAGTGTG
GTTGCCGAGTTGGATCTGGCCAGATTCCACCAACGGTCGCAACATCGACATGTTGTCGGTCCAGGAGTCGTAGACTCCGT
TGACGAAAAACGTCAGCCGTATGTCGGTGTCTTTGACAAACTGCACGTAGGAACGCACTACCTCGGTATTGACGCCGTCG
TCGACGGTAAGAGCAAGCAGATCGCCACGACCCGGGATCTTAGATAGCACACCACCGCCAGGCAATGGAATGCGTGCACT
CGTTGGTGGCGGCGGCAATACACCTGCGGCGTTAGGAGTCGGCGTCAACTCGGCAACCACCGGCGCTTGGACGAATGTTC
GCGGTTGCGGGCCGACCACGAGGCGTACTGCGCCGAGGCCGGTCACAGTGGACACGGCAAGCGCGCCCAAAAAGCTACGC
CGGTTTAGCGCTGACACAGCAAAGCCTCGAGCACACGTATGCACCATGACAGATCCAGCAAACCCAATCCGGTCATTGTG
AGATGGTTTGCGGTGCGATACACGATAGACAAGCCCGCTTGCGGGATGCTCATGTCACCGACGTCGGCCTCCACAGCAGC
AAACCGTACCACTAACAGGGAAAACTATGCCGGATAAGTTGCGGCAGGTCAGCCACTGATTGAAGATTCAATAGTTGACC
TTCAATGACGTTTCCACCATCATGGTTGAGAAGCGTTCGAGTCCGGTTTTCGATACAGGTTCCGTCGCGGCAGCGAATGT
TCCACATTAGGTAACCGGTGACTAGATGACGGGCTCTTACTATACTTATTTAAGATGTATTGACCACGGTGCAGAGTGCG
CTGCTGTGGAGCCGCGAGCGATTCGATTGTCGGGGAGATGGTGGAATTCGAGCACCACGACGCCGCTACCGCGCCAAGCA
CCGATCACGTCATCACGTGTCGTCCAATTTGGCTCTCAATGTATCTTGGCAGCTAGCTTGCTGGGGTGATGAGGACCGGT
GACGTCGTTGTCGACAAGGTCGAGTCGGTGGATTGCCCTCTTCGCATTCTTAAGGAATGTGGCCGTTGCTAGCCGTGGGG
TTTTCCTGAAATCGACAAGGATCTGCGCCAATACCGATTCAGCGGCTAGGTACACCGCGCAGCGTGCCGATTCACCAAGT
CTATAATCGGCCAACACACTACAGTCCGTACTGGGTCATCCTGAGCTCTTCTCCGGCAGTAATCATCGTCGAACCCGATG
CACTTGGCTGATGGCCGACTGCCTGTTGGGTGACCAGACCAGAAACGCTACGAATTGATTAGCTACTTCCGTTGAAACAC
TGCCTACCGCAATCCAGCCGTAGGCGTCGTAAGTCGCCGGGGTCACTTGCGTAGGTATAGCATCCGATGACAAGACCGGC
GCACGCTTGCTACCCATGTTGGAGCCGCAAGGTTGTCCACACTTTCCCGCTCGATCAGCGAATCAGCGCTGGAATTGACG
ACCGGCCGATCTGCAGTTATTACGAAAAGATATTTCGCCGCACATCCGATCGCGGCTCGTGAGCTTTCCTAGTCGTCGA
ACTGTATCCGATACTAAACAATTGTCGAGCTGCAAGTCATCCGGCTGCCCGAATTACTCAGGCACCCCAGAGTTGCGGGG
CGGCAACTGTACAAGCTCGGCATCGGGGGTTCCCAGCACTACGGCCAGCGGGTGGATCGCGCGGCAACGCCGGTGCGAC
AAATGGCCAGTTAATGTCTTCCGGACTGGGTAACTACCACGCAATTGATCCCATTGGCCGCGGCTGGTGCTTGAGGACAC
TCCGGTGGGTTAGGACGCTAGGCAGGTGACCATCGAACCAGCCCGAAACCCCGGTGTAATGACCGTACCGAGTCATGACC
ATGATCGTGTCGAGGCAGGTCAGGCAGCGAAGTTGCTGCCAAACAACCCGACGATAGCTTGGTCCTTTGTGCCCTTGTTG
GGGCGTAGGTCGTCGACGATGTCCCCGACGCTGGTGACGGCGGTCGCGCTGAAATGTCTGGATGCATGACGGTCAAGTC
GACGGCGCAAGTACCGCCCATCGACCAGATAGCGATACCCCAGTTGGTCAGAACTGCGGCCACCCCGAAATTCGGGGGCA
TGAATGGCACAACATCTTCCGCTAGATGGTCGGGGGGCGTTACCGCGGATCCCGTTGACGCACTCGGTGTCGGTGTCGAA
CGAGCCGGTGGGGTCAACGAACATCAGCGTCGGAGCGAAGCCGTGATGACAGGCCGCGCGGTTTGTCGATGGTGTCGAAA
CCGCCCCTAGAGCGCAGCCAGTACGCAGGAGTGTTAAAGGCAGAACTATGATCATCATAACTGGCGGCAGCTGGTGAGAC
GGATTGCTTTTGAACCATGCCAGGGGCGAATACATCAGTTCCTGGCGGTGGGTAAAACCGGACGCGGCGAAACTATGTCT
ACCGGCACCACGACACACTTGGTTGGCTTGATCCCGGCTATCTGCATTTCGGTGACATGCAGCCGATCGATCTGATCAGG
CAAGGGCCCTGCCGTCAATTGATTCCAGGCAACTTGCACCGTGGGGAAATAACCGTCCCATAGATTCAAGACCAAGGTTG
CGCACAGCGGCACCTACAGCAGCGCCAGACCACGGCGCTAACAGCGGGCACCTGACCAGCCCAGCAACAGTACGGCCGCA
GCTAGCCCACTTAAAGTTACCCACAGCCACAACGACTTTTGTGCTGGGTCCCAGCAACCCCAATCGAGGTGACGTACCA
ATACGCCAGCGCCGTCACAGCGGCTGCGACGCCTAGCACAACGGTAGTGTCCGTTTAAGCCAACGGCGCCTGGCCCATTA
CCTATCGCTTTGATAACCATGAGCAGAGCAGAACCTTGTACGACCGCCGGCAATCAGTCGTGCAGCAAGAACGGTTGTTC
GGTAATAGGAGCAACAATCGTAGCTTTCGTTAAATCCACTGACTGCGCGGAGTCGGATGGTACAAAAACAGAGCCAAAGG
CGATTACTCTACTACCAGACCAGCACCACTTTAGACCTAGTCTAAAGCCGCTGAAACTGCAATTCGATTGATTCATCGGT
CAGGTGAGCGTATTGAACTTTAAGCAGGTCGCCCCAGCGCCGTGGCAAAGTTAGCATAAGCCAACAGGATTCTAACTCAT
GCTGGTGACCAAGCGCAGACTTATGCTATTGACGACGATCAAAGCTCTGAGGAACACCATCACAGGGCCAGCCAGCACCA
GGGATGCCCACTGCCAGTTGCGGCAATGCAATACAGGACCGGGATCACGGCATGGAGATCGCTGGTACGACGAGCACGT
TCTCGACGACCAGGTATTGCCTAGTGAGATCAGCTTAGCTTGGTAAGCCGCCTGTTCTGTCGCCGATTATACCGCATGTT
CCGGTATGGAATTCTGATGGTGTTGCGGGATGAGGTGAAGTTTAGCCGGTCTTTTCGATTTCGGTGAACAACTTATGAGG
ATCATAGCCTAAAGTGACTGTGACGGTGTCTTTTTCGGTAGTGTAGTTTACGATGGAATTTCCCCAGACGAGATTATTCT
AGTTTCTTTTTCGATGCGCGTAGCGCACGAGGCATACATAATTCCGGTGTCGATCTTGAGCTCGATATGGCTCATCGTGGTCG
GAGGGGCAGTTATCTTGGGCATGGGCGCTCTTTACTCTGGCATGCCAATGTACATCTGGAAGTTTGAAGCAGAGCAGGCG
ATTACGCCGCGCACGAGATCTACGATCGCAGCGGGAACCCGGATATCGACATGCAACCAAGCCGGCTTCGTTAACTGCAT
CCAGCACTGCGGCTTCCTCAATCGGCCTCAATCGGCGCAGAAACTGGTGGCGATGAGCCGGCCCGTCGTCCGGCGGTCA
ATCGCTACGGCTTGGATACCAAAATCCTGCCTATCTGGCGCTGAATGGACACCTCGCAATGCCAACAGTTAACCCCGGT
TGCTATACTGTTAGTAATTATAGCATTCCTGCACTTAAATACCCAGCCGAGGCAAGCCTAACAATAAAATTGTAAACCGA
AATAGGGTATATCTGTCAAGGACGTCACCACTGTTGGCAACAGTCTGGCATCCCCACACATCAAGTCAAGCCGCCAACCG
AATGGGATCGGACTGCCCGCCGGTGGCCGGTGTTGGTCTGGAGGCGGGCAGTGCTAGTGACAACTCGATGCATCGTAGCC
```

FIGURE 10(continued)

```
TCAACTTGGCACTGTCGTAGTCAACATTAGGGATAAGGACATCATGACTGTCACCGTTGTCGATACGGCACCAAGGCTGC
CAGCCAATCTGTTGAAGTAACCATGCCAGTCGCCGAATTCTATGCGATTGTGGCCAATCACCAGCGCCACCACGAATTGG
ATGGTCCTGGAACGGTAGGTGACAGCATTTAAAATGGAAGTAGAAGCAAAATTAATTGCAGGATCGAAAGACCAAAATGA
AAAATGCATAGTATTCCCTACCGAATCACCAGTACGGTTACCACTCCCAAACCAAACGAATTTAGTAAATTAGCAAAGGG
GTGCCATTCTGTAGGCCACAGTTAGCGGCTGGAATTTTGAGTTGTTATCGCTGATATTACCCCGGGTAACCAAAATATTC
GGCGATCATGATGAGCAGTGAACTCGAAAACCGATTAAAGTACCTATCAGTATATTAGGTACCCGGAAGGTCAACCCGGT
GAGTATCGCGGCTACACTGGGAAAATTTCGTGATCGCTACGCTAGACCGTAGCTAATGTGTCTACCAATCGGCTTCGAAC
AGGCCCCCACTGCGGTAGAGCCGGACCATCGTGGCGTCCGTAATCGGTGTGGCTCCGCAAGAACACTCTGATGCCCGCCA
CTCCTTATGGGAAGCATGTCGTGGTCAGACAGAGCTGTGTAGAGCTCTGGCTCGAAAGGGGGAACATGGCGAAATATCCT
TGCTGTCAATGGTGCCGGATGTCATACAACAACGTATCCGTTTTGGAGTGACCAAGGGATTGGCGGGTCGGGTATTCCTG
GGCAGGGTCATATGTAGCGATCTTTCCTTAATAGTGATTGTTCCACAAAAATTCGGACAATGCATCGGATATTGCGGGGA
GGTGTTCGAGACGGACATACTGTGCGATGTGGTCGACGGCGAACTAAGTTGCCGAGACCCCCGCGGACACCCGGCCCTGT
CCATGGGCCGGATTCTCGCCACAGCTCTACGAATTGCTGGAAGAACAGGAGTTTATTCACTGTCGATGCAATCGCTGACC
CAGCTCCTGGATTCGGACACTGCTACACTTTATCGATCGTCACTTCGCGACACGATCGAAATTTGGTCGCGATAGTGGGT
CGACTCCATGCCTGAAAAAGTTAACCTTCGATGCTCAAAAGGTCGTCGAATTGCCCTGGTAACATACCTGCATCTTAATT
GTACAAAATGTGTTCGACGCGCACAGTCGGCACCCTGCTGATCGAATATGCCCTCTTACCAGGCCCAACGCGCTGGGCGA
CCGAGAGATGTGTCTGTCGGGTCGGCTCGACAACGAATTTCCACCGGTGGCGGTTAGTTGCGCCTAAACCGCACTGGACA
GCTATGTGCTCGGCTGCGCGATGCAATTTTCCGGGGTGGCACCGGCAGAAAAAGACGCAGAACTATCGGCGACCTTACA
GCAGCTGAATCCTTTTCAGCTATCCTGCTAAGGTCGCTGTTGCCAATGGCCTCCCGGTTCCATTAGAGTAAGAATTCGTA
TTCGGTATTGCATATTTATTCGGTATTGCATATTATTGTTGCCAGGCTAGAGTAATTTGGCACATAATCGCATGCCGAGA
AGGCTGAGGTGTTAAAGTACGATGTCCGTCGCGACTTCTCAGGGGCGGCCTGTCGGCAATCGCGCACAAACCGGCAGCA
GGATACGGTTGATGTCGGTTCTTTAGGTGCAACTCTGCGCGGGCGGCAATAAGATGCTGTTGGTCCTGAACAGCTTGAAA
AATAACGTATCCGGCGTGGCGACGTGCAGGATCTGCTCACGCGGATCGACACGTCCAGGTGGCCGGCCTACCCGACGACA
CACTATTCGCAGCGCACGGAGACCGTGGGTACAGGTGAGTACGTGAGCGTGGCGTAAATTCTTCCGCGAATAGTCCGATT
ACGAGAGACCACCCAGCAGGCCGATGTCATAGGGCCGTATAATAGACAAATTCCGACGGCTTGCCAGAGTTATCCGGCAA
TGTTGCACTACGCTCCTATAACCATCGCCGCGGTCACATACGTCGACGAAATCCCCGTAGCCGACCGTCGCCCCCGGTGC
TAGGTACGGGGCAAGCCGCGGCGCCTTGAGCCCACACCGCCGGCTTAGGTTCCGAAGGCCAGTGCTTCAGCAACAGGCGG
TATCCTCGACGGTGGCACCAGACCCGGCCTGTGCACCGAGAGGCAAGCCTGTCGACGCTCATCCTGAGTAAT
CAGCTCAATGGCAACACCCGGCTGGGTAAAATGTGGCGGTGCTTGGGGTGCACAGAATTCACCCTCGATGAGCCACACGG
TCTCGATCATCGAGAAAACGCACCGATGATCATGCGCGGCAACGGCAAGGTGTTACGCCAGGACGTCACAAATCGTACGC
CCGCTGTCGAACGCTTGTTTCGGAGTTGCTATCAGGCTAGCAGCGGATGCTATGTGGAAATTCTCTGAGCGCAGGGGGCT
ATCCAAGCCACTCTTGAACGCGACAGACCGATATTCTTCTGCGGCGAATTCAATGTCGACCCAACTACGACAATATATGA
GGTCGATTGCGAGCTTGACACCGTTGATGTCATGGTGGTGGTATGTGGTGCGAATTATTTGTGTTTGTGTCCACACGCAA
CAGTAGTCCTAACGCGATGTGGATCCTATATGGTGGCTGTCGACCGCAGAGGCAAGCCTGTCGACGCTCATCCTGAGTAAT
ATATTAATTATAGTCGCCCAGTAGCTCTGTTCGATCGTCTCACCCACAGCGGCAGTAACGCTACGCTAATTGACTCGAAG
ATCCGCGTGTGTCTCTCTTCTGCTGGTGGGTAAATATAGAACTCATGATGCTACTGCTGATTGCCGATACCCATGTGCCA
CAACGCGCACCCGACATGCCCGCACAGGTATGGGACGAGGTCGCAAAGGCTGATGTCGTAGTTCACGCCGGCGACTGGGT
ATCGCCCAAATTACTCGACGAGCTGGAATCCAGGGCTGCTCAGCTGGTCGCGTGCTGGGGAAATAACGACGGGCCCGAAC
TGCGGTCACGACTGCCGGAGCGAGCAAACGTGACATTAGCAGGCATGAATTTCACAGTTGTGCACGAGACCGGCGCAGCA
GACGGCCGCGAAGCCCGGATGTCGCAACTGTATCCGGACGCCAGGTCTTGGTGTTCGGACATAGTCACATACCATGTGA
TACCACGACGACGACCGGTTTGCGCTGCTGAATCCTGGCTCGCCAACAGATCGTCGCCATCAAGCTTTTGCAGCTACA
TGACCGCTAATGTCGACAACGGGGCATTAACGGACGTAGTCGTCCACCCGTTGGAAAAATAGCTAGTCTAGTATAGTAAA
GCTTATTGTTAGAGTTCAATAATCTACCTGCCTAGGCGCCGAGCATCATCGCGTCCTTCGGTTGGTCTCACGGTAACCAG
TTCGATACAGCGCGGCGCCCCGAGTCACAGTCTCAACTGCTACAAGCTTGTCGGCCAGCAGCCGAGGAACTCGGTCAGCT
TGACCAACCACACCGCATCTAGCAGATCGCTAGTGATGACGATCGACGCGTGACATCGAACCTATCACTATGATCAGTTC
AACGCCGTGAAGAAATCTGGGCTATGTACCGCAACAACTTTCTGTCCAACCCACGTTCGGCGTCAACTGTGTTGCGCCGT
CTCGTTTCTTAGCTACCTAAATAGTGCATCCGCTATATAATTTTCATAACTTTCGAAGACCGCAACATCGTCCCGATAGC
CAATCGTGAGTTGGACGTAACGAAGCCGAGCTGACTCTTGATTGTTAACCAACTGCAACAATGAGCTCGGGCCGCAGCAG
CCGATTCAGCCGCGACCCCTATGTTTAAATCGCCCAGGACAAATTCAACCGCATCATGCGGCAGTATGGAAGTTGGGATG
GGTAGAAGCCATGAAGTTCTTGCAGCAGATGCGAAAGTTGTTTGGCCTGGCGGCAAAGTTTCCGGCACGGCTGACCATCG
CAGTTATAGGGACTGCCCTGTTGGCCGGCCTTGTCGGTGTCGTCGGCGACACGGCTATAGCAGTAGCGTTTTCTAAGCCG
GGTCTTCCAGTGGAATATCTGCAGGTGCCATCACCGTCTATGGGCCATGACATCAAGATCCAGTTCCAGGGCGGCGGGCA
ACATGCAGTGTACCTGCTCGACGGGCTCCGGGCCCAAGAAGATTACAACGGTTGGGACATAAACACCCCGGCTTTCGAGG
AATATTACCATTCCGGCTTATCGGTGATCATGCCGGTCGGCGGACAGTCTAGCTTCTACAGCAACTGGTACCAACCGTCG
CAAGGAAACGGTCAGCACTACACCTACAAATGGAGACGTTCTTAACCCAAGAAATGCCCTCGTGGCTACAAGCCAACAA
GAACGTGTTACCGACCGGTAACGCGGCGGTGGGCCTGTCGATGTCGGCAGTTCCGCACTAATCCTGGCCTCGTACTACC
```

FIGURE 10(continued)

```
CGCAGCAGTTCCCCTACGCCGCCTCGTTGTCGGGCTTCCTCAACCCATCCGAGGGCTGGTGGCCGACAATGATCGGCTTG
GCGATGAACGACTCGGGCGGCTATAACGCAAACAGCATGTGGGCCCGTCCACGGACCCGGCATGGAAGCGCAACGACCC
GATGGTGCAGATTCCACGGCTTGTCGCCAACAACACTCGGATCTGGGTGTACTGCGGTAACGGCGCACCAAACGAACTTG
GCGGCGACAACATACCGGCGAAATTCCTGGAAAGCCTCACGCTAAGCACCAACGAAATATTCCAGAACACCTACGCAGCC
TCGGGCGGACGCAACGGAGTGTTCAATTTCCCACCCAACGGAACACACTCGTGGCCGTACTGGAATCAACAACTGGTTGC
CATGAAACCCGACATCCAGCAAATACTCAACGGCAGTAACAACAATGCCTGATACCATCTAACCCGCAAACCAAACAACA
ACCCGAGGCGCTAGGACAACAGAGCACGATGACAAGAGTGAAAGTAGGCACAGCCCAGTAGGCACCACGCACACGACAGC
CGCAATCGCCGACATTTGGGATTCCGCGTAGGCGCACGCTGATGGCACTACCCGACACAAAGCTGGCGAACAACAAAAT
AGCCGCGACAGTCCGTCACTTTTCCACCGGCGATGTGACGTTCGATGCCCCATCTCATCTTGACCAGTGTGCCTGTCACA
TATCTAATTGGGATCGACACCTCACCATCTTTGACATCCGGTGTGGTCAGCATGCCCAGACCGAAAACCACAAGCAGAAT
TGGAGTGAAGTGAGTCGGATTTAATTACATCGGCCCACGAGAATGTCGCACCCTGCCGCCACAGCAAGTCGCCTACACCA
GCTCGGCATCGGCCTCACCTGCGACAGCCGTGCCTCGCTGTCGAAAACCTCACGAATCCTACATCCACGGTTTCAGATAC
GCCCAATGCTCACAATGCGCAACCGCACTGGCAAAGCGGAACGAACAGACCCAGTGAACAACCTAGGCAGCGGTGCGCCA
GGCACTGGGCACCGTAGTAAGACTTGGCAACCATTCGGCCTGGAACCGAGTCTCATACCCAGCTTCATAGACCGCCTTGG
CGAGCTAGTAGGCGACCATTAAGTTGTGCCAAACTCAGCGATCGATCCCGACACGACCGCGTAGCCTTCACAAAACGCGG
GGCGGCAAGCTGCTTTCAGCGGCGTGGTCCACGAGTGACCTTTAAGCAGCGTAATCGAAAAAGAACAACAGGCCCGGTCA
CGTATCGCGTAACAGCGAATCTGGCACCCGTCCAACGGCTGGCCCGGCTCACCCTCGAAGTCAATCAACAGCCAGCTCTC
CGGGGTACGCAGCACCTGTCCCAAATGCAGATCGCCATGTACCCGCTGAACAGTGACCTTCAAGTTCGCGAGCTTTTGGA
ATCGATCTTCGATCGGTGCCACGATACTGCCCGAGTTCCAGAACCGCCGTCAGAATCGTCGATGCCGTGTTCAGTCGGCC
GCGGGGAAGGTGACCTGCATCGTCCCCAAGCATTCGGCCAGGGTGCCGGAAAAGGCTATCGGCTACAGCAAGCATTGAGG
TGTGGCAAGAGCTTATAAAGCGCATCAAAGCTCGCGCGATCTCGGTAGAGGCAGATAGTTGCTATGTTGCTGTACTCCG
GTAGCCGGTGCGAAATCGCACCCCACTATCACCTGATAACGCTCTTATGAACCGTCACTGTAGTTGGCGTTGCCAACATC
AAGTCGAGGTCGTCTCGAAGCAAAGCTATTACCGCAAGATCAGCGGTGGAAAGCTCAGCGATTGCGTACGACGTACCAAA
GTTGCTGTTCACACCTAAGCAACTTGGCTGGCAGAGTCATTGACGTTAATCAACACTAATTGTTTTGCTTTGCGACAAGT
TATGGCTTTCTCATCATACACGGACAACTGGAACCAGTAGAACCCGTGCCTCAGCCAGAGTCAATAGATAGGGTTAGGTG
GCCGGAACACGGAAACTCCACCTACCCGGTAAGCTGGACCGGCGTGTAGCCGTTCCAATACGGCAGATTGAGTTCGATGA
GTTGTCGAGAACAGCGGCAAGCGATGAGTTGTGAGAACAGCGGCAAGTTGTTGACGCTCAGCACAGTGTCGCCATCACCAG
CTGTTTTGCCTACAAAAGACGATACTGGCGAATGCGAACCGTGTAACTCCTGGAAAGCTTCAATGGCAACGTCATCATGC
TGTCGACGAACTGTCAGCATTATACTATGAATACTGGGGTGAAGTTGAGCACCGAGGCAGAACTTATAGCGTTACTTCTC
CAACACTGACAACGTGGTAGCGGTAGACCGAATCTTGGCTGGATAGGCAGATAAAGCCGCTCCGGGTTAGCCTTAGATAA
TCGGGCATTGCGGACCAATGTCTTTCCTATAATTGAGTGGCATGCACTCCGTCGTGATCTCCCCAACCATCTCACGTCAC
TCTAGTACAGGACCGGCTAGCCGGGCAACAACAGTAGAGCGAGTAGAGCGGTGAACAGCTCGATTTGGTTACGGTCGCTA
TCCAGCAGTGGTGCCAGGCTGCGCCAGCTTCCGACATTCGCCTTCATCCGTGGCTCCTTGGCGTATTCGGCATACATGTA
GTCGCGTTCTTCATCGGTGACCATTTCCAGTGGCAACTCGTCGTAGTTGCGCAGGAAAATCTCCCACTGAGCCATCTTTG
GAACTGCCGGCGTCTGCGCCAGGATCTTCGAGATCGGGAACCACGACTACCCCAGCCGCGGCGACATGAAGATACGCGGC
ATCAGCTGGCAGTAAAACGCCATATGGCCACATCGGCATTAGTCACCACCGGCGGCGGGCATCACCGAACTACAAGACCAA
ATCGGACGGCCACTGATTAGCTTCTTAGCTTCGTCCAGCAGTACCTGTCCCAGGAATTTGTCGTCGTCGACCACTTTGCT
ACCGCGCTTAAGGAAAGCATGCTTCTCGGAAAAATTCTCGCAATTGGCACAAATCGAGCTCGAAGAGGTAGGGCACCACT
TCCAGCTGAACCCCGTCGATGAACATGACAAGTCAAAAGAGGAGAAAATCGATCCTCGCTTCTTGCACGTTCACATTGTC
GTAGTTCAGATCCGGTTGGTGATAAAAGAAAGATATGCCAATAGCACTTGGTAGCGGACCGGGTCGAACGTCCAGTTAGA
CTCTTCGCTGTCGACAAAGATGATTCGAGCTTAGACGTATTCGCAGAATGCGGGCAGCACCTTATATGAAATACCGTATA
TCGTAGCAGACATCATGCAGCGGGGAGTCATAGAACAGCAGAAGCCAGATGTAGTCGATGCCGAGCTATTGCCGGTAATG
CAAGCGGTCTATTGAGTCCCCGCAGATCGACCAGCACCGGCGGAACTAACGTAGTAGAACGCCCGGACCAATCCCTCGTA
AAAGACAACTTGCTCGAATCAAGTCGAGTCTACAGTCGGTACAACAGCGTTACCGAAATCCTCGGCACTCGGATGCTCGA
CTACACCCCCTTCGACGTGACTGTCGCCGCAGGATGCTGCTCACCAGCCTCAACGAGATGGACTTCGTTGATCAATGAAC
CCACAATGCCACAGATACCCGAGGCAAGACACCCTGGGATCAGGCCTGAGATCAAGCATCGCTCCAAGCGAATTGGCTGG
CCGGCAGGCCGCGCCACTATCCGACCGGATGTCAAGCTGGAGGTCCCTCCGCTAACGTCACATTCGCGGTGAGGTCACCG
CCGCCAGCAGAGCGATAGTTCACCGCAACGGTTTCCCCAGGATGATGCGGCACGAGCACATTCGTCATAGCGGTGGCCTC
GCTGATGGGTACACCGTCGACCGACGTGATGATGTCACCTACCGAAATCCCAGCCATCGCGGCTGGACCCGTCGCGACCA
CACGGGCAACCCGTGCGCCGTTGCCGTTGTTGTCTAAAACGCCCAGGCCAAAGAAGGCCGTCGGGCCTATGTGTACGGTG
TTTGACCCAGCCCCGGACCGGATGGCACCGACGACCTCCATCGCCTGACCAATCGGAATGGCGAAGCCCTGCCCACCCAA
CATCTTGTAGTTATCGGTAGCAGCAGTGTTCATGCCGACCACCTCGACCTCGGCTGTTGACGACGGGCCCGCCCGAATCGC
CGGGTTTGATCGGGCGTCGACCTGGATTAGTCCGGACAACGTCTCTTGGGCGCCGGTCAGGGGTTCAGACGCTTGGACG
GTCTGGTTAAGTGCTACGACACGACCCGGCAACACGCTGGAAGTCCACCCTGGCCGCCCGTGTTGCCCAGAGCCACAAT
CGGTTCGCCGATCGCCACGTCACCACCGATTACTGCGGTAGGCAGGTTACTCGCGCACGAAGCTGGAGCACCGCGACGT
CCTGGGTACGGTCGTAACCAACCACGTCGACGCCGTAAGTTTTGCCATTTCCGACATCGAACGCACTGATATCGGTAGCA
```

FIGURE 10(continued)

```
CCCGAGATCACGTGATTATTGGTCAGCACGACACCGCTGGAATCGATAACGATTCCCGTCCCGGCTCCCACCGCGCTGTT
GTAGCCTAATCTAGTGCTGATATTGACCACCTGAGGCGCAACCATCGCGGCGGGATTGAGCGGCAGGGGTGGCCGGTTGC
TGAACCGATCGAGCGCCAAAGTGGACGGTCCAGACGGTGTGGCTGACCCTGGAACCACGGCTAGACTCAGACCTAGCGCA
GCTAATGTACTTACCAGCCATGACCGCCAGAGTGAACGGTGGGGTTGTCTGCTCATCCCGTAATCTCCCGCATCCAGCTA
AGAACTAGAATTGTTCCAACCTTCGGTTCTGGGTGGCATGACTTTGTGTATATCAAGCTAGTGCAAATTGCTGTCGGCTA
CACATTTGGGATATCGCTCCGGCCGGCGAAGAACGGAACGCTGAGGTTGCTGTCAAACGATCAGCTGTGCTGACGTAACG
GGGTTAAGTGAGGTCGCGCCGGGCGGGGAGATTCCCCTCACCTTAAGGTCGGCTCAGTGCTACACACAAGCCGATGGTTC
CCCCTGTATATTGTCGTCCCACTCAAGACGGTCGTGGTATCGGTCCGAGCAACAATCATCTACATCGTAAACCCCGCGGT
CTGTTGTCACACGATTGTAGTAGCTGAGCCGGGTCACGATACCAGCGTCCTCGTCGACTTCGAGAGCGGATTGCTAAACA
CGTGTGTGATTCGGGGTGTGCTATCGGGATAAAGCATGATCAGTGACTTCCAGATCGCCAGTAGCCGGGTGGCATTGACT
GTGCCGTCGGCCTGATGCGGATATCGGCAGGCTCGAAGAGAGCGACCGCCCCGCCAGGTCGTGACTGTCGATACGTGCG
GCATAGTGACAGAGGAAGTTTGCCATCTGAGTACAACTCTCCAGGCCGTTAACCTAGTGTGGCCCTACCTACACCGACAC
TGTACGGGAATTCGACCCGACGAGCTGACGTCCCCCGGCAGACCCGGGTCAACCAACGCAAGCCAGTGCTACGGCCCAGT
CATTGGTACCCGGCCAGCAGCCTTGTGTTAGGCAGTCGCTGATGGGAAAGCTGTTTACCGCATACTGTTAGATGGGACAC
ATACTTATGTAGGGCGTGTGTAATGGCCCCGGAAAACTACGAAAAGGAAAAGATCTATAGCGGACAGGAGTGAATGGATC
CCCGAAACACGGTAGTCGTTCCCACCGCGAGCAGCCCCAACAACGTTCGCAATGTGGTTCTGGTCGGTCCGTCCGTAGCT
GGTAAGACCACCTTCGTCGAAGCACTACCGATCGCGGCCAGCCTGTTACCCAGACCGGGCACAGTGGTGTACGACAGTAC
GGTCTACAACTACGGCGAAGCTGAAATCTGTCAGCAGCGGTCAGTGGGCGTTACCCTGACTTCATCTACTTATACGACA
GCATCAAGGTCAACCCCGTCGACGCACGCCCGGATACACCGATTTTGTGGGCGAGCTGCGAGCCGCAGATTGCACGCCGT
TCGTCATCGCGGCAAACCAGGGCTTCGGTGGATAGTCCTCGATCCGCAGCAATCACTAAGCTCGGCCACTCCCAAGATGA
ATTATCAGGAGACACTTTCTGCCGCAAAAAACACGTTCAAGAAAGAAATATACCACTTTCCTTCCTACTGAAGACGACCT
GATCGGATTGTTGTCACAGACCTGCGATCGATTACAATGGCGGCCCAGAGCAACGGACGCCAACGACCCGTCGGACGCCG
ATCGTACCCGAGCAAGCGCGCGACACCCTGATTGAAGGAATTCTCTAGGAATCCGAGGATGAGTCGCTGGTGGAACATTC
AAGGACAAAATTCTTCACACCGAAGGGTTCGCTGGGTTCGCTGCACGTCTAGCTGGCTTGTAGCGCTAACGGTAGTTACT
TGCAGAGGAGGTGAAGACGACGTCAGACCCTACGGTCGGCAGGGTCGTCCTGGTACAGATGTTTTCCGAGACCACCAACC
CTGACACGATAGTTCACATGTCGCGCGATTTTGCTGTGCTTCGAGTTCGGATAACAGCGCGCAAGCATCTGGGCAGAGTG
ACCGTGACAAGGATAAACGTATCGGGGTCCTTGCATTCCCACTCAGCGGTCAGCAGCACTCGCGCCCGTGGCGGTAGTG
GGCGACATCTGAGTGATCAGCAAACTAGTACGAGCCGGCTACCCGGTGGTCGACGTCCGAGTCACACCGCTGGACGGTAA
AGCACACAGCGTCGCCCCTTCGGACTTAGCATTCCCGGCGGCGAGTGCGGTGGCCTTACGGAAAACGGCAGCTGCGATGA
CGGTTACCTTGCTCGAGCCGATCGACGAGATCTCTGTGCTGATATCCGATGATGTCGTAGACGCGGCGATGGGAAGAACC
AACGCAAATGATTCAATTCACATACGACGTCGTGTTATTCACCCGCTATGAACCTATGCAGGAATCCGCAACGTCCTGGG
TGAATACCACGCATGTAGACGTGTATTTATTATAAAATATTGACGATTAGCGAATTTCTCGCCCACAGACTGCCAAACAT
TTTGTCGTCTTGGGTCCGCTGACCGCCATTTTGGTGATCCGTTGCGTGCTATGGACCGCAACGCGACGGCGACTGATCTA
GCTGGTTCTGGTACTTACCGGCGGTACTCTAATACCTTGATATCTTGATCCCATTGACCAAACGCGCGAGTCTGATGGTT
AGATGGTTAAAATCCGGATCGCCCTGTCCATCACCTTGCGGATTCACAAAGAACTCGGCGAAACCTTGATCTACATCTCC
TTGCACCGCTGGTAGCCGTGTTCGCTTTGCTAACCACTGTCCATATTCGCCGGACAAGCGGACAAACGGTGAAATGTACT
TTGCACGAGACTGATCGGAGTTCTGGTGATCGCTGACGCTGTGGCCACACTGGTCCAGACCTATCACATCGACGATGTGG
GTGCGTGCAGACCGAGTGGGAAAACGTGGCTTCGAACGTAACTGGGTCCTCACATCCTCACCCCGATGAGCGAACTGTT
CGGCCACGGCGCGGCGGTCGAGCGAACCTTTGGCGGTGTGCGGAAGCGCGCTCGCCTCCTGAAATCTGGTGGGCACTTCG
AAGGCCGCCAACCGATCACGGCAGAACACCGCAAGCTCCGACGGAGTCGGTGCTATGACCTCGCGAGGAACAATCACTGC
GGTCACTGTCTCCCCGTACACCTTGTCAGGATCACCAAATACCGCTACCTCCATAACGTTGTGGTGACTGGCCAATACAC
CTTCGACGCGCTCCGGCGAGATCTTCTCGCCGGAGCGGTTTATGAGTTCCTTGATCCGGCCACGGATCCTCAGGTCACCG
GTTACCGACAGTGACCCCAGATCACCGGTACGCAACCATCCGTGGGTGAAGTTCGCTGCGGTTATCGCCGGATCACCCAG
ATACCCACGCACCACTGTGGAGCCACGCAACCAAACCTCCCCTACGGTATCCGGGGGAGGGGTTGACCGTCGGACCCGA
CGATGCGGATCTGTACGCCAGTTGACTGACCGACAAGACCGTTTGTTACGGTGGGATTCTCCCCTTGGCCGAACCATTTT
ATATTTGTGGTTGTCACCTGGTGAGTGGCCTCGGTCATGCCGAAAGCACATATCACCGGCGCCAAGAACTCTTCACGCAG
CGCTTGCGCCGTTTCCTGGGTAAGGGCGCACTGCAACTGCGGATAAAGCGGAGTTTGGCTCGCTTACTCCGGAAAGATT
GAGTAGAAGCGAGTTCCAACAAGATCCGATGAATCGCCGGCGCGGCCGTGTACCAAGTAGCCGCAACGGCATCGATGTCG
TCCCAGAATGTGCGCGCCGAGAACCGCGCGCGAGCAGGGAGCAACACCACACCTCCAGATGCCAGGGTCGACAGCAACGC
AGCAATGAGCCCATGACCATGGTAGAGGGGCATCACCACGACAGTCGCATCCTGTGGGCCGAGCTGGTACGCGGTAATGA
TGGCGTGAACGGAACCGGCGATATTCCCGTCTGTCCACGGGACCATCTTCGGCAAACCCGTCGTTCCTCCAGTGAACATG
ATCATAGCGTCATCGTGCCGGAGCCCGTCAGGCGTCGAAGTGACTGGATGCAACGCCGCAGTGTCGTCCAGGTGGACCAA
CAAGCTGCCTTCCGAAGCGCCTGTGACGCTACCGTAGGAAACCGCAATCGGCCAGTAGCGCATCGTCGCTGCTCGCTGGT
CGCTAACGCCTTCAAGGGCAAGACTGTCCACCAATGTCACTCGCACGCCCGCTGCTTGGCTCCGGATGCATTGCTCATTG
ACAGGTAGAGCCGGATCTAACGGCACCACAATCAGGCCGGCTCGCGACGCCGCTAGTAAGCCTACAACGAATTCAATGTT
GCTAGCCGCGCACAGCGCTACCCGATCGCCAGGCAGCAGGCCACCCAGCGCCAGCTGGACGGTCAAATCATCGACCAGTC
```

FIGURE 10(continued)

```
GGAGCAAATCTCGGTAGCTCACCACTATGCGATTGTCGGTCACGACAAGCGCTGGCGCGCTTGGATTCCGAATTGCTGCC
GCCTCGACCAAGCTGGCGATACTCGGGCTTTCGAATTGGCCAGTCAGCCTCGCATCTATCTGTTCAACCGGAGCTCTGCT
GCTGGTAATCGACTCCGATTTCATCGCCGCACTCCTTACGCCTTCTTCGATATGAACAGCGTTTCTCTTCAGAAAACCAT
GCCACGCAGTTTTGTCATGCGTCCAATAACCACCCGATAATGCTTGATAGCGAATACCATTGAAACGGCAATAATACGCC
GACTAACAGGTAAATATAGTCCTTCGATAGACGACGTGGATCACCGCACAGCGGCTTAGGCTTGGACAGCGACGAGTCCG
CCAAATCAGTGTGATTACATCAAAGCCGTTGCGGATCGCCTACAGCCCGCCTAGACGCACACGATGTAGTCGATTCTTAA
CATGCCCCTCCCTGGCAGCGAAGCGGCGACAAGGGCGAAAAGCGCGCGTTTGACCGCGTTGTGGATCCGCTCAAGGTCAA
CGGCATCGAAACAATCTACAGGGTCGTTGGTATCCCGATCACCGACCTCGTGCGTATCGCGTAGGTGCTTGGAATCCGCC
ACATCAGCTTCCGTCAGAAGACCTCTGTCCAACGCCGTGCCGCTGCTGGATTCCTCGTCCGACGCCCGTGTGTGTCTAAT
TGGAATGGTGGCGGCACCCGGCTTCCTCAACAGCCTAGTTGCCTTGGCAAACGCCACGATTAATTGCTTTACGCTGATCC
AGACCTAGGGTGCAAGCAATCAAGCGCTGGTGGATCGGCATTAAGAAGATTACGATGACCTCGACCAGCTCAACGCTGTA
AAGCCTTTCGCGAAGGCGACATCCCGGATTGACCAAGCAAGAACAGGGCGCGCCATTTGCGTTTCAGTGTTGGGCTTCCC
GGGCACCGCTTACCTCGATATCCCTCGGTTATACGATGGTCTCGGTCCTTGTGCTCCCGGCCGCATCCGACACAATTTTC
CAGTTCGTCAATCTCGCGCCCCGTCAGCTGTCGGAGCCGGAATCGGTTGATCGCGCATTGAACGCGTTGGCACAGGAGTA
GCCCCGGCTGTTCGTACTCAAGCTTATGCACAAGCAGACAACATGATGCAAGCCATGTCGAAGATGTCTTGAGAAGACAT
CCACGTGGATGTTGATGGCCAAAGGGCTATCGCCCAACTCCATACCCGCAGTCCGCTACCGCCGCGCGTTCGCTGGCCAT
CGTAAGCAAGTGCAGGATTGGCCGGGTCAACGCCCGGCTGAACTGGCTTATCGGCGACGGTGAATCGCCGCAGTGGCATA
CTGATGCAAAATTTGTTTTTATTCAAGTCGATTTGTTTTTATTCAGATTGATATCGCGGTGGCGGAGTTCGGCAGCGGCC
GGCTGATCGCGTCGCCACTGGACAGCTAAGTTGGTGCGGGGAGGTCGATGCTACTCAACGGCGCGACTACGAGTCGGATC
GTCGCTCCCACATATTGGACCAACGAGCTGGCCAGATCACAAAACAGCAAACGGAGTCAAAATCCGCCAGTGTCTGGCCG
ACGATATCTCATCCAATGCATTTCGACAACGCACTGAACGTCATTCGCGATGTTCCGCACAATCGCTCGATCTGTGTCTC
GACCACCGGAGCCCATATACTCGCCCCGGCCAGTAAATTCCTCAAGATAGAGAAGCCAGCACCGACTTGACACGGAAACC
TGGGACGTGATGGGTATCGGCATGGCTATGCTATTGCCGACGCGGTCCCCTCATCAACCTACAACATCGATTTGACTAA
ACGCTCGCGCCACAACGTAATCGAAGAAGTCTTCGGCAGTCAAGTATATTATCTCATAACACTTTATTAGCTGCGGTCGA
TGCTAACCGAAGCGATCACATCGAACGGATTATCAATCGTTGACTTCGAGCTCGTGGCATCCAACCGTGGAGGTGAAAAA
CGGACGCCTCGCGCGCCTCAAACCCACGAACGCCGCAATGCCGCAATATCGGTCAGCGTCTACGAGTGATTCCCGCTAAC
TGAGCTTCAAAAAATTCGTTCAACGCCAGTTGCTTGGCGGATGCGACGAGCGCACGGGCTACCGGAGAACCTGGCCCGGC
GGAGTTGGTGGCGAGTGCGACGTCGGCTTTCAGAACCGGATCAACCATTTCTACCGCACGGATCTCTGCGCCTATCGGCG
TCGTCCACAGCCAGGTGTGCGGAACAATGCACGCCCAATTTCCAGTCGCCACTTGAGCGAATAACGAAGCGACAGAGTCG
GTCTCTACTTGCGGGGTAGCAGTGATCGCGTGACCAGCAAAGGCCCTATCAATAAGCTGGCGGTCTCGCATGTCGGGCGT
GAGTAAAGCCAGCGGCAGCTGCGAGGCTTCTGGCCATGCCAACACCGACGCCCAGGCGGCAACATATCCGCCGGCGATA
CCAACACGTAATGTTCATGGTAAAGCGGCACCAGGTCCACAGCGTGAGTGTCGTCAGGCGCGGAGTGTACGATGACGGCA
TCGAGCTCAAAATCGCCCAGCCGTCGGTGCAGTTCAGTGACAGGCAGTCGGGAGCAGATTTGCACTTTTATCAATGGGTG
CTCCGAACAAAAAGCCGAGAGGACCAGGGACCGTGTCGTCGGACAGTAGGCACCGTGCCTAATCGAAGCGTACCAGTGA
TCCCGGACCGCACTGCATGCACCTCTGCCTTGAATGCATCGTGTTCGGCGAGAATACGCTTGGCCCACACGACCAGGCGC
TCCCCTTCGGGCGTTAGGCCCTCAAAGCTGTGCCCCCGGTTAATCAGTGTGACGTTCAGCTCACGTTCGAGTTTGGCGAT
CGCGGATGAGAGCGCAGGTTGCGAAACGTAGCACCTTTCGGCCGCTCTGGCGAAGTGCCGCTCCTGGGCTACGCGACGA
AGTACTCCAGTTGACGGAAGAGCACCCGTACCTCCTCCCTTTGGGTACCAATCTCGCTGAGGCTAACGCGTCGCTACCAG
CCCATCCAACCTACCCACTCGAAGCAACCGCAAATAGATTTCTAACAGCCAGGCGTTAGCTCGGTATTAGCGGACAGGTG
GCGATGTTGAAACTACGAATACTTATGTGTTGCTGCTATTTTCACCACACGGAGACCAAGGCCTGCCAAGTTCGGAGTGC
TGCGAACAGAAGAAATTTGTGTTTCAGTTCAACAACATTGCAGCAATGACTCAACGATAAGCAATGAGCTATTATTGTCT
AGCACGCCGATCCACACAAGGTACGCACCAACCGCCCCTCATGCTGGGACAGTGCGCAAAAGACTACCCGAACAAATTAA
TCAACGTTTGCTAAAACCTGTAATGGGTAGATGGCCACTAAACTAACTAGAGTAACGTTGTGTTGACCGCACCATCTCGA
AGGGCGGAAGCCATGTATCAAGCGGTTCGTTATCTACTTGTCATGGCCGCGATCATCCTGATGGCGGTGGCAGAATCAGG
CAGCCCTAGCGTGGCCGCTATCCCTGCACTAAAGCCGACCCCTGAAGTTGCTTCGGTGCTGCCTACTAACGGCGCGGTGG
TGGGTGTGGCTCATCTGGTGGTGGTGACGTTCACCGCACCGGTGACGGACCGCTCCGCCGCTGAGCGGTCGATTCGTATA
ACATCGCCGAACAACATGACCGGCCACTTCGAGTGGCTTGATGGAGATGTCGTGCAGTGGATTCCAACCAAGTATTGGCC
CGCCTACACTCATGTATCGGTCGAGGTTCAGGCGCTGACGACGGGCTTCGAAACCGGTGACGCGTTGCTCGGCGTTGCCA
GCCTGTCCACGCACACCTTCACCGTCAGCAGAAACGGAGAGGTACTCCGTACCATGCCGGCGTCCATGGGTAAGCCCACC
CGGCCGACACCGATCGGTAAGTTCACCGCATTGTCTAAGGAGCGCACCGTCGTGATGGACTCACGAACCATCGGTATTCC
GCTAAATTCTCCCGAAGGGTATTTGATCACCGCGCAGTACGCGGTTCGGGTTACCTGGAGCGGCGTCTACGTACACTCAG
CCCCATGGTCGGTGAACTCACAGGGTTACACCAACGTCAGTCATGGATGTATAAACCTAAGCCCAGACGACGCCACATGG
TATTTCAACACCGTTAACGTCGGTGACCCGATCGAAGTGGTGGCCTAACGTGAGGCAACCGCGGTGTCGCTACGCGAGGA
ACACAACATTGTGCGGACTAACGGGCACATTACGACGGTTTGCCGACGGACTTCGTAGCCGAGGTAGTCACCTCACAGTT
TGCAAAGGTGTACGGCGGCTAGCGGTCCGACGACGTGATGAACCCACACGATGACGAGCTATTCTCGGATGTGTTCGTGG
CCTGGCTACTCGAAGCTGGCCACGACCTCCAGCGGATCGATGACTATGACCAAATAACTAAGGCGTTTCGAACCCGCTCT
```

FIGURE 10(continued)

```
GCGGGCTTTGCAGTACAAGCAGCGGTCAGCCCATTGATAGCTTATCAGAATCCGGAATAGCCGACGGATATTCGGCTAAA
GGTAGTGCAGACAGCCAAAATTGTTGTGTATAAAAGATATTCCGCATCCATCGCTGGTTTTAATCGAACAAGTACGTTAC
GGATCTGCGGATACTTGGACCGGTTTAACCCGCGACTATGCTGGCTGCGCAGTACTTGCGGGGCAGCCAGCCTACCGAAG
AGAATCCGACATTCGGATCTAAAACGTGCAGAAATTGGGTAAGTCGTTGAATTGACCGGCGAGCCACAACAGCAGCGGAA
TGATGGATGCGACCACCGCGCCGTCAGCACGTGGTTGATTGAAGTCTTTTCAAGGAACGACGGCTCCTCGGTGGTCTAGA
ACTGGACATAGGCTCCCTGCTTGCACCAAGCATGTCCGAGTGGGTTTGAGATGCGTACACGGCACCAACGGATTATAGTA
ATTACTGGCGCTCAATACCGGTAATTTTTTTACTTTATAGCGCTAGATCAGCTGAATATCAAAAATTTCTTGACCGGCTC
TTCATTGACAAGTTTATCCATATCGTCGTTGAAATATCCGCGGAGATTCCGTAACTGGAATTTGAGCAGCTTTTCATCGA
TGCATTGGGGGCGAGTTCTTGGCCAGTAAATCTTCACCGTACAGAGTCAACAACTCGTTAATCACTGCAGCCTATTACGG
ATAGGAATAAATGGTCCCATGGAGTAAAATCCGGCGTGCCGAACAGGGCGTTGCCGTCGATATAGTGCAGCGTTTCGGAC
TAGGTTGACGGACAATACATCAGAATGGGCACCCATTACATTCCTCGCCCCAGGGCGTAGGCCAACGCAAGTAGGTACGC
TGAGGCCAGCATTGTTTGTGGCCAGGTCCTCATAGTCGGGTCATGACTATGAGGACCTGCGGGCTACCAGCGTCGCTACA
AACGGATTCTTCCTAGCTAGCCATGCAGTAACAACTACAGTGGCCAGTGTATTACCTGGCTGAACAGCCGGGGTGGAACG
CAATGGTACCCTGATCCTGGATGTTCGGCTCGTAGCCGAGCCCCCCTTTCCGGGACCAGGGATTAATCCGGGTCGAAGTG
CGGGCTGGTTTATCGTGATCAGCCGGCTGCGGGAGTTGGTGCTGCGGTAGGCGGCTTTGCTGCAGCACCTGGGTTGAAGG
CAGGGGGCTCAAGCACTAAAACCTCATTGGCTCGGTGCGAATCAACTCGGGTGGGCTAGACTGGGCGACAACGAGTCGGG
TGGTGTATGGGATTCCGCGTCCTGACTTTGATAGCCTTCGAAATAAAATTGGCCTTCGGTAGTTCCCGACGAACATATCT
CACCAAACCCACGGTAACACAAAATTAAGCTAAATGCAGGTGCAACAATGAAATTAAGGTACCCGAAGCATGGCCGGGAG
ATTACCGACGGCGCCAACGCTTAAACAAACAGAACCGGGAAGGAAAACCCGCAACTAATTAAGCAATCCATTTTTTATCG
CGGTCGCTTGCTGCTACCGAATATAGGCTACAAACCCTTGGATCGATCGGATCGTTGGTACACTGTCGAATTTAAGATTC
ACGAACGCTTTACCCTCGATAAATTGGCATACCGACGCCGGTGGAGAATTGCTGGTGCAGACCGGGATAAGGAAGGAGGT
GCTGACCGAGCGATTGTCATTGGTAGTCCGTTACTGCGAAAATTGGCGGGAACACAAGAGGCCGATAAATGGCCGCACAG
GCCCATGGCCGGAAATGTCTTACCACCTATGTGTATGTGCGACAACGCATAAGCTTCGATACACAAGTAAGGAGCTGAAG
ATGACGGCGGCGGTGATGCGTGTTGTGCGGTCGACCGTTACGGAGGTCGTAGCGTGTTATAATTAGCCAACGTCTATAT
GCCGCTGCACAGTCGTGGCGAGATAGTGACCGATTTTCACACAGACGGCATCAACCTCCGGCGAAGACACCAGCAGCGGC
GGTGCGGTGCACGAGATAGACATTCCCCCGCCGAGTTTTCGTTCGGCGAGGGCCGCCGACCTTACCTGCGTAGTGACCGC
CGTGTTGCCTGACGTCGTCGAGTTCTTCGTCGACGACGAGGGCCGGGGTGCAGCTTCCACTGCTCCAGCCACGCCATTC
ACACCGGTGGTCCGTTGGGGCAGTTGATCCCGAAACCTCCCTTAATTGAGTTGGGAGGTAGCTGGTTCGCTGTATGTTGT
CGAGAGGCGGCGTAGACAGCCTTGTCGTGCAGTTGTTGGTTCTGCTCAAGGAGCAAATGTTGGCATTTATAGGGCCAAGC
AACGCCGACTGACTGCGCTCGTGTGGCGTCCTCCGGATC
```

FIGURE 10(continued)

COMPARATIVE MYCOBACTERIAL GENEOMICS AS A TOOL FOR IDENTIFYING TARGETS FOR THE DIAGNOSIS, PROPHYLAXIS OR TREATMENT OF MYCOBACTERIOSES

CROSS-REFERENCE TO RELATED APPLICATIONS

This application is a §371 application of PCT/IB02/01973, filed Feb. 22, 2002, which claims the benefit of U.S. Provisional Application Ser. No. 60/270,123, filed Feb. 22, 2001. Applicant claims priority of each of these applications.

BACKGROUND OF THE INVENTION

The present invention is directed to a method of selection of purified nucleotidic sequences or polynucleotides encoding proteins or part of proteins carrying at least an essential function for the survival or the virulence of *mycobacterium* species by a comparative genomic analysis of the sequence of the genome of *M. tuberculosis* aligned on the genome sequence of *M. leprae*. The selection by the method of the invention of these or peptidic sequences of interest which are encoding said essential functions of *mycobacterium* leads to identify and characterize specific antigens or regulator sequences, said antigens being chosen as potential candidates for an immunogenic or vaccine composition, but also useful to determine novel potential drug targets for the pharmaceutical industry. The molecules having essential functions encoded by these genes or corresponding to regulatory elements represent also new highly specific targets for chemotherapy. The sequence of the polynucleotides according to the invention have the particularity to be maintained during the evolution of the *mycobacterium* and therefore have been highly conserved in pathogenic *mycobacterium* species. The invention is directed to purified nucleic acid selected by the method of the invention as well as the purified polypeptides with essential functions for the survival or the virulence of *mycobacterium* species encoded by these sequences. In a preferred embodiment, the invention is directed to genes that code for essential proteins for which the functions have been attributed. The invention is also directed to a process for the production of recombinant polypeptides and chimeric polypeptides comprising them, antibodies generated against these polypeptides, immunogenic or vaccine compositions comprising at least one polypeptide useful as protective antigens or capable to induce a protective response in vivo or in vitro against *mycobacterium* infections, immunotherapeutic compositions comprising at least such a polypeptide according to the invention, and the use of such nucleic acids and polypeptides in diagnostic methods, vaccines, kits, or therapy.

To illustrate the new approach of comparative genomics for identifying essential molecules as regulator nucleotidic sequences and proteins for the survival or the virulence of *mycobacterium* species, the inventors made several examples which will not limit the scope of the present invention. A comparative genomic analysis, which permitted the inventors to select the sequences encoding essential molecules as regulatory nucleotidic sequences and proteins for the survival or the virulence of mycobacterium species, has been made by analysis of the complete genome sequence of both *Mycobacterium tuberculosis* and *Mycobacterium leprae*. The whole genome comparisons led also to the identification of genes that are present in both *M. tuberculosis* and *M. leprae* but have no counterparts elsewhere. The polypeptides having essential functions for the survival or the virulence *mycobacterium* species are characterized by at least 40% identity at the protein level and at least 70% identity at the gene level between both genomic sequences. The amino acid sequences have been compared using the program GAP,"GCG" (Genetic Computer Group) from Program Manual Wisconsin Sequence Analysis Algorithm of Needleman and Wunsch.

(J. Mol. Biol. 48:443, 1970) The parameters are chosen as follows.

For amino acid comparisons:
Gap penalty: 5
Gap extension penalty: 0.30
Length: the sequence to be compared are the following XXX SEQ ID NO:XXX and having XXX amino acids.

For nucleotide comparisons:
Gap penalty: 50
Gap extension penalty: 3

Also the parameters could be adapted case by case.

Other techniques are known by the man of the art for the comparison of sequences. We can refer to the algorithm of Smith and Wateman (Ad. App. Math. 2: 482, 1982), the method of search of similarities of Pearson and Lipman (Proc. Natl. Acad. Sci. USA 85:2444, 1988), Zhang et al. "A greedy algorithm for aligning DNA sequences" (J. Comp. Biol., 2000, February-April 7(1-2), p. 203-214), these algorithms are used by the way of informatic tools (GAP, BLASTP, BLASTN, BLASTX, BESTFIT, FASTA and TFASTA in the Wisconsin Genetics Software Package, Genetics Computer Group, 575 Sciences Dr., Madison Wis.).

The recombinant clones carrying DNA from *Mycobacterium tuberculosis* and *Mycobacterium leprae* strains containing genomic sequences of said bacteria, have been deposited at the Collection Nationale de Cultures de Microoganismes (C. N. C. M.), of Institut Pasteur, 28, rue du Docteur Roux, F-75724 Paris cedex 15, France, and are designated as following.

HRV37 genomic library, deposited on Nov. 19, 1997 under the accession number I-1945.

A recombinant BAC containing a fragment of *M. tuberculosis* genome deposited on Feb. 20, 2001, at the C. N. C. M. under the accession number I-2625.

A recombinant BAC containing a fragment of *M. tuberculosis* genome deposited on Feb. 20, 2001, at the C. N. C. M. under the accession number I-2626.

A recombinant BAC containing a fragment of *M. tuberculosis* genome deposited on Feb. 20, 2001, at the C. N. C. M. under the accession number I-2627.

A recombinant BAC containing a fragment of *M. tuberculosis* genome deposited on Feb. 20, 2001, at the C. N. C. M. under the accession number I-2628.

A recombinant BAC containing a fragment of *M. tuberculosis* genome deposited on Feb. 20, 2001, at the C. N. C. M. under the accession number I-2629.

A recombinant cosmid containing a fragment of *M. leprae* genome deposited on Feb. 21, 2001, at the C. N. C. M. under the accession I-2632.

A recombinant cosmid containing a fragment of *M. leprae* genome deposited on Feb. 21, 2001, at the C. N. C. M. under the accession I-26330.

Leprosy, one of the oldest recorded diseases, remains a major public health problem. Although prevalence has been reduced extensively by WHO multidrug therapy and vaccination with BCG (Anon, Karonga Prevention Trial Group, Lancet, 348, 17-24, 1996; Nordeen, S. K., et al., eds. Walgate, R. & Simpson, K., 47-55, World Health Organisation, Geneva, 1993, the incidence of the disease remains worrying with more than 690,000 new cases annually (Anon, WHO Weekly Epidemiological Record, 73, 40, 1998) in the world. Leprosy was common in Europe in the middle ages but gradually disappeared.

In 1873, in the first convincing association of a microorganism with a human disease, (Hansen, G. H. A., Norsk Magazin for Laegervidenskaben (supplement), 4, 1-88, 1874) discovered the leprosy *bacillus* in skin biopsies but failed to culture *Mycobacterium leprae*. A century later, the nine-banded armadillo (Kirchheimer, W. K. et Int. J. Lep., 39, 693-702, 1971) was used as a surrogate host, enabling large quantities of the *bacillus* to be isolated for biochemical and physiological studies. Subsequent efforts to demonstrate multiplication in synthetic media have been equally fruitless although metabolic activity can be detected S., Antimicrobial Agents and Chemotherapy, 33, 2115-2117, 1989). The exceptionally slow growth of the *bacillus*, which has a doubling time days (Shephard, C. C., eds. Hastings, R. C., 269-286, Churchill Livingstone, Edinburgh, 1985), may contribute to these failures.

The means of transmission of leprosy is uncertain but, like tuberculosis, it is believed to be spread by the respiratory route since lepromatous patients harbour *bacilli* in their nasal passages. The bacterium accumulates principally in the extremities of the body where it resides with macrophages and infects the Schwann cells of the peripheral nervous system. Lack of myelin production by infected Schwann cells, and their destruction by host-mediated immune reactions, leads to nerve damage, sensory loss and the disfiguration that, sadly, are hallmarks of leprosy.

There is no data or technical information in the prior art which permit to select specifically potential new targets and protective antigens for new drugs and vaccine compositions to treat and prevent mycobacterial diseases, particularly tuberculosis and leprosy. Furthermore, there is a need for the development of new tools for the selection of genes which are encoding for essential proteins or regulatory nucleotidic sequences in the survival or infection of *mycobacterium* species and useful for the design of antituberculosis drugs and vaccines based on the knowledge of comparative mycobactertial genomics.

SUMMARY OF THE INVENTION

The invention aids in fulfilling these needs in the art. The method according to the invention has the advantage to reduce drastically the number of potential new targets and protective antigens by giving for the first time an exhaustive description of conserved proteins in the tuberculosis and *bacilli*. The isolated and proteins described in the present invention, which are highly conserved in both genomic sequences of *M. tuberculosis* and *M. leprae* are by this characteristic essential for the survival or the virulence of these mycobacteria in the host. The identification of antigens and potentially therapeutic targets has been made on an evolutionary basis by a method of comparative genomic analysis.

This invention provides a method for the identification and the selection of essential genes for the survival or the virulence of *mycobacterium* species which comprises:

a) aligning the genomic sequence of a first *mycobacterium* species on a genomic sequence of the genomic sequence of a second *mycobacterium* species, b) selecting a polynucleotide sequence highly conserved in both genomes with no counterparts in other bacterial genomic sequences and which corresponds to an essential gene for the survival or the virulence of *mycobacterium* species, and c) optionally, testing the polynucleotide selected in step b) for its capacity of virulence or involved in the survival of a *mycobacterium* species, said testing being based on the activation or inactivation of said polyucleotide in a bacterial host or said testing being based on the activity of the product of expression of said polynucleotide in vivo or in vitro.

This invention provides also a method for the identification and the selection in silico of essential genes for the survival or the virulence of *mycobacterium* species which comprises the following steps:

a) aligning the genomic sequence of a first *mycobacterium* specie on a genomic sequence of the genomic sequence of a second *mycobacterium* specie, and b) selecting a polynucleotide sequence highly conserved in both genomes with no counterparts in other bacterial genomic sequences and which corresponds to an essential gene for the survival or the virulence of *mycobacterium* species.

Optionally, testing the polynucleotide selected in step b) for its capacity of virulence or involved in the survival of a *mycobacterium* species can be carried out, said testing being based on the activation or inactivation of said polynucleotide in a bacterial host or said testing being based on the activity of the product of expression of said polynucleotide in vivo or in vitro.

The method according to the invention permits also to determine the polynucleotidic sequences, which encode for polypeptides and regulatory sequences essential for the virulence and/or the survival of *mycobacterium* which are, in one hand, specific to *Mycobacterium tuberculosis* and, in the other hand, specific to *Mycobacterium leprae*, that is to say, said polynucleotidic sequences are not found in publicly accessible banks of non-*Mycobacterium tuberculosis* and *Mycobacterium leprae* genome.

A gene according to the invention is a defined nucleotidic sequence, which contains an open reading frame with base composition, codon usage, GC skew and other features typical of a microorganism, preferably a *mycobacterium*. The definition of gene according to the invention comprises nucleotidic sequences, which encode an antigen or a fragment thereof, or nucleotidic sequences, which encode for essential polypeptide with essential function in the host, or nucleotidic sequence, which encodes polypeptide with regulation function in the bacteria, by example, in the DNA expression or in the transcription. An essential function for a polypeptide in bacteria according to the invention comprises functions implicated in the survival or in the virulence of the bacteria.

In a preferred embodiment the first genomic sequence of *mycobacterium* belongs to *Mycobacterium tuberculosis*. The *Mycobacterium microti* is a *Mycobacterium* which infect the vole. It has a genome sequence close to the sequence of *Mycobacterium tuberculosis* and therefore in a second preferred embodiment, the first genomic sequence of *Mycobacterium microti* belongs to *Mycobacterium* genus.

In another preferred embodiment the second genomic sequence of *mycobacterium*, belongs to *Mycobacterium leprae*.

In a preferred embodiment, the method according to the invention comprises the complete genomic sequence of said *mycobacterium* species which is analyzed. This invention provides purified polynucleotide molecule obtained by the method according to the invention.

Further, this invention provides a purified polynucleotide molecule according to the invention which encodes essential proteins or fragments of proteins of *Mycobacterium* species.

The invention also encompasses a purified molecule of a formula selected from the group consisting of polynucleotidic sequences, which encode for polypeptides and regulatory sequences essential for the virulence and/or the survival of mycobacterium which are, on one hand, specific to *Mycobacterium tuberculosis* and, on the other hand, specific to *Mycobacterium leprae* that is to say, said polynucleotidic sequences are not found in publicly accessible banks of non *Mycobacterium tuberculosis* and non-*Mycobacterium leprae* genome. In a preferred embodiment, this purified polynucleotide is obtained by the method according to the invention.

The invention encompasses a purified polynucleotide molecule that hybridizes to either strand of a denatured, double-stranded DNA comprising the purified polynucleotide sequence according to the invention under conditions of moderate stringency in 50% formamide and 6×SSC at 42° C. with washing conditions of 60° C., 0.5×SSC, 0.1% SDS.

This invention provides a purified polypeptide of a formula selected from the group consisting of SEQ ID NO: 1 to SEQ ID NO: 644.

This invention also provides a purified nucleic acid molecule encoding a polypeptide of a formula selected from the group consisting of SEQ ID NO:1 to SEQ ID NO: 644.

The nucleic acid molecules of the invention, which include DNA and RNA, are referred to herein as "*M. tuberculosis* and *M. leprae* marker nucleic acids" or "*M. tuberculosis* and *M. leprae* marker DNA". The polypeptides encoded by these molecules, which are referred to herein as "*M. tuberculosis* and *M. leprae* marker polypeptides," have formulas selected from the group consisting of SEQ ID NO: 1 to SEQ ID NO: 644.

Further, this invention provides a purified nucleic acid molecule that hybridizes to either strand of a denatured, double-stranded DNA comprising the nucleic acid molecule encoding the polypeptide of a formula selected from the group consisting of SEQ ID NO: 1 to SEQ ID NO: 644 under conditions of moderate stringency in 50% formamide and 6×SSC, at 42° C. with washing conditions of 60° C., 0.5× SSC, 0.1% SDS. This nucleic acid molecule that hybridizes under the stated conditions can be derived by in vitro mutagenesis of a *M. tuberculosis* and *M. leprae* marker nucleic acid of the invention.

The invention also encompasses purified nucleic acid molecules degenerate from *M. tuberculosis* and *M. leprae* marker nucleic acids as a result of the genetic code, purified nucleic acid molecules that are allelic variants of *M. tuberculosis* and *M. leprae* marker nucleic acids, and a species homolog of *M. tuberculosis* and *M. leprae* marker nucleic acids. The invention also encompasses recombinant vectors that direct the expression of these nucleic acid molecules and host cells transformed or transfected with these vectors.

The invention further encompasses methods for the production of *M. tuberculosis* and *M. leprae* marker polypeptides, including culturing a host cell under conditions promoting expression, and recovering the polypeptide from the culture medium. Especially, the expression of *M. tuberculosis* and *M. leprae* marker polypeptides in bacteria, yeast, plant, and animal cells is encompassed by the invention.

This invention also provides labeled *M. tuberculosis* and *M. leprae* marker polypeptides. Preferably, the labeled polypeptides are in purified form. It is also preferred that the unlabeled or labeled polypeptide is capable of being immunologically recognized by human body fluid containing antibodies to a *mycobacterium*. The polypeptides can be labeled, for example, with an immunoassay label selected from the group consisting of radioactive, enzymatic, fluorescent, chemiluminescent labels, and chromophores.

Immunological complexes between the *M. tuberculosis* and *M. leprae* marker polypeptides of the invention and antibodies recognizing the polypeptides are also provided. The immunological complexes can be labeled with an immunoassay label selected from the group consisting of radioactive, enzymatic, fluorescent, chemiluminescent labels, and chromophores.

Furthermore, this invention provides a method for detecting infection by mycobacteria. The method comprises providing a composition comprising a biological material suspected of being infected with a mycobacteria, and assaying for the presence of *M. tuberculosis* and *M. leprae* marker polypeptide of the mycobacteria. The polypeptides are typically assayed by electrophoresis or by immunoassay with antibodies that are immunologically reactive with *M. tuberculosis* and *M. leprae* marker polypeptides of the invention.

This invention also provides an in vitro diagnostic method for the detection of the presence or absence of antibodies, which bind to an antigen comprising a *M. tuberculosis* and *M. leprae* marker polypeptide of the invention or mixtures of the polypeptides. The method comprises contacting the antigen with a biological fluid for a time and under conditions sufficient for the antigen and antibodies in the biological fluid to form an antigen-antibody complex, and then detecting the formation of the complex. The detection step can further comprise measuring the formation of the antigen-antibody complex. The formation of the antigen-antibody complex is preferably measured by immunoassay based on Western blot technique, ELISA (enzyme linked immunosorbent assay), indirect immunofluorescent assay, or immunoprecipitation assay.

The polypeptides of this invention are thus useful as a portion of a diagnostic composition for detecting the presence of antibodies to antigenic proteins associated with mycobacteria. Thus, a diagnostic kit for the detection of the presence or absence of antibodies, which bind to the *M. tuberculosis* and *M. leprae* marker polypeptide of the invention or mixtures of the polypeptides, contains antigen comprising the *M. tuberculosis* and *M. leprae* marker polypeptide, or mixtures thereof, and means for detecting the formation of immune complex between the antigen and antibodies. The antigens and the means are present in an amount sufficient to perform the detection.

This invention also provides an immunogenic composition comprising a *M. tuberculosis* and *M. leprae* marker polypeptide of the invention or a mixture thereof in an amount sufficient to induce an immunogenic or protective response in vivo, in association with a pharmaceutically acceptable carrier therefor. A vaccine composition of the invention comprises a neutralizing amount of the *M. tuberculosis* and *M. leprae* marker polypeptide and a pharmaceutically acceptable carrier therefor.

In addition, the *M. tuberculosis* and *M. leprae* marker polypeptides can be used to raise antibodies for detecting the presence of antigenic proteins associated with a *mycobacterium*. Purified polyclonal or monoclonal antibodies that bind to *M. tuberculosis* and *M. leprae* marker polypeptides are encompassed by the invention.

The polypeptides of the invention can be also employed to raise neutralizing antibodies that either inactivate the mycobacteria, reduce the viability of a *mycobacterium* in vivo, or inhibit or prevent bacterial replication. The ability to elicit mycobacteria-neutralizing antibodies is especially important when the proteins and polypeptides of the invention are used in immunizing or vaccinating compositions to activate the B-cell arm of the immune response or induce a cytotoxic T lymphocyte response (CTL) in the recipient host, or other T cell mediated response.

Further, this invention provides a method for detecting the presence or absence of a *mycobacterium* comprising:

(1) contacting a sample suspected of containing bacterial genetic material of a *mycobacterium* with at least one nucleotide probe, and (2) detecting hybridization between the nucleotide probe and the bacterial genetic material in the sample, wherein said nucleotide probe is complementary to the full-length sequence of a purified *M. tuberculosis* and *M. leprae* marker nucleic acid of the invention.

Also, this invention provides a method of comparing genetic complements of different types of organisms, wherein the method comprises:

(a) providing a database including sequence libraries for a plurality of types of organisms, said libraries having multiple genomic sequences;

(b) providing one or more probe sequences encoding a polypeptide of a formula selected from the group consisting of SEQ ID NO: 1 to SEQ ID NO: 644;

(c) determining homologous matches between one or more of said probe sequences and one or more sequences of said sequences in said genomic libraries; and (d) displaying the results of said determination.

The method can be carried out using a computer system comprising a database including sequence libraries for a plurality of types of organisms, wherein the libraries have multiple genomic sequences, and providing a database including the one or more probe sequences encoding a polypeptide of a formula selected from the group consisting of SEQ ID NO: 1 to SEQ ID NO: 644. The computer system includes a user interface capable of receiving sequence information from the sequence libraries and the probe sequence information for comparison and displaying the results of the comparison.

BRIEF DESCRIPTION OF THE DRAWINGS

This invention will be described with reference to the drawings in which:

Figure 1:
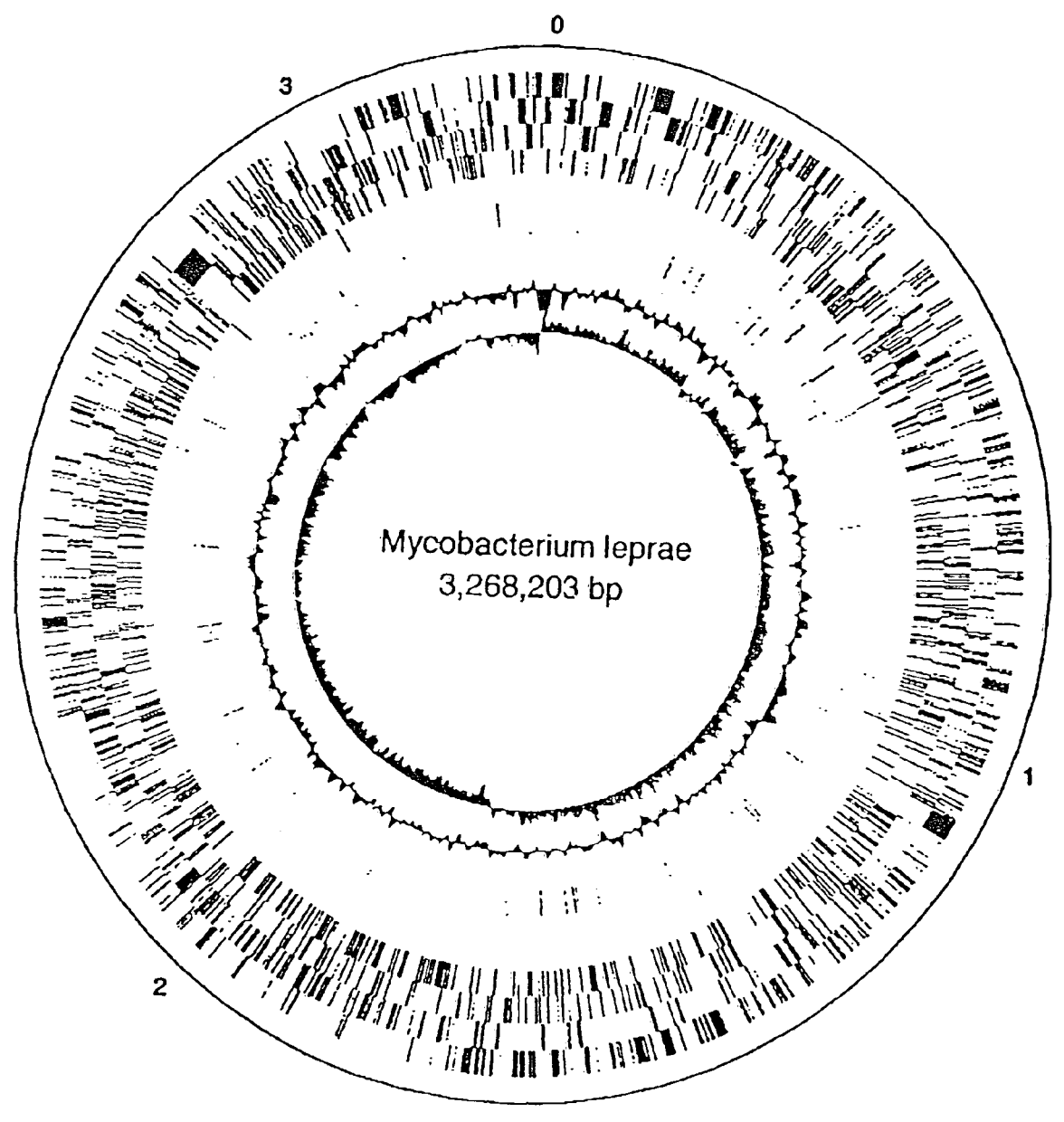

FIG. 1 is a circular genome map. From the outside, circles 1, 2, clockwise and anticlockwise, genes on the − and + strands, respectively; circles 3 and 4, pseudogenes; 5 and 6, *M. leprae* specific genes; 7, repeat sequences; 8, G+C content; 9, G/C bias (G+C)/(G−C).

FIGS. 2A and 2B are a comparison of the proS loci of *M. leprae* and *M. tuberculosis.*

FIG. 2A: the *M. leprae* proS region is shown above that of *M. tuberculosis*. Genes or operons are depicted by arrows while crosses denote pseudogenes. Note the absence of ugpAEBC and dinF from *M. leprae* and the presence of proS at this site.

FIG. 2B: domain structures of prolyl-tRNA synthetases of bacterial (*M. tuberculosis*) or eukaryotic (*M. leprae*) types after (Wolf, Y. I., et al., Genome Research, 9, 689-710, 1999).

FIG. 3 shows distribution of genes by functional category. The number of complete (grey) and pseudogenes (black) within each category for *M. leprae* is shown. Data for *M. tuberculosis* (white) were taken from the published genome sequence (Cole, S. T., et al., Nature, 393, 537-544, 1998). Functional categories: 1. Small-molecule catabolism, 2. Energy Metabolism, 3. Central intermediary metabolism, 4. Amino acid biosynthesis, 5. Nucleosides and nucleotide biosynthesis and metabolism, 6. Biosynthesis of cofactors, prosthetic groups and carriers, 7. Lipid biosynthesis, 8. Polyketide and nonribosomal peptide synthesis, 9. Proteins performing regulatory functions, 10. Synthesis and modification of macromolecules, 11. Degradation of macromolecules, 12. Cell envelope constituents, 13. Transport/binding proteins, 14. Chaperones/Heat shock proteins, 15. Cell division proteins, 16. Protein and peptide secretion, 17. Adaptations and atypical conditions, 18. Detoxification, 19. Virulence determinants, 20. IS elements and phage derived proteins, 21. PE and PPE families, 22. Antibiotic production and resistance, 23. Cytochrome P450 enzymes, 24. Coenzyme F420-dependent enzymes, 25. Miscellaneous transferases, 26. Miscellaneous phosphatases, lyases and hydrolases, 27. Cyclases, and 28. Chelatases. Inset graph: The Y axis shows the number of genes within each functional category. The X axis shows the functional categories: 29. Conserved hypothetical proteins, 30. Hypothetical proteins which share no significant similarity with any protein currently in the databases.

FIG. 4. Polynucleotidic sequence (SEQ ID NO: 645) of the *Mycobacterium tuberculosis* H37Rv BAC clone, BAC-Rv221, deposited at the C. N. C. M. under the accession which corresponds to with partial digest fragment from the genome of *M. tuberculosis* H37 Rv that starts at position 2,115,612 and extends to position 2,198,604 according to Cole et al. (1998). All of the *M. tuberculosis* genes contained herein are of interest.

FIG. 5. Polynucleotidic sequence (SEQ ID NO: 646) of the *Mycobacterium tuberculosis* H37Rv BAC clone, BAC-Rv230, deposited at the C. N. C. M. under the accession which corresponds to BACII with partial digest fragment from the genome of *M. tuberculosis* H37 Rv that starts at position 1,336,764 and extends to position 1,411,979 according to Cole et al. (1998). All of the *M. tuberculosis* genes contained herein are of interest.

FIG. 6. Polynucleotidic sequence (SEQ ID NO: 647) of the *Mycobacterium tuberculosis* H37Rv BAC clone, BAC-Rv234, deposited at the C. N. C. M. under the accession which corresponds to with partial digest fragment from the genome of *M. tuberculosis* H37Rv that starts at position 2,847,864 and extends to position 2,928,420 according to Cole et al. (1998). All of the *M. tuberculosis* genes contained herein are of interest.

FIG. 7. Polynucleotidic sequence (SEQ ID NO: 648) of the *Mycobacterium tuberculosis* H37Rv BAC clone, BAC-Rv265, deposited at the C. N. C. M. under the accession which corresponds to with partial digest fragment from the genome of *M. tuberculosis* H37 Rv that starts at position 513,402 and extends to position 599,515 according to Cole et al. (1998). All of the *M. tuberculosis* genes contained herein are of interest.

FIG. 8. Polynucleotidic sequence (SEQ ID NO: 649) of the *Mycobacterium tuberculosis* H37Rv BAC clone, BAC-Rv267, deposited at the C. N. C. M. under the accession which corresponds to with partial digest fragment from the genome of *M. tuberculosis* H37 Rv that starts at position 1,124,621 and extends to position 1,169,811 according to Cole et al. (1998). All of the *M. tuberculosis* genes contained herein are of interest.

FIG. 9. Polynucleotidic sequence (SEQ ID NO: 650) of the *Mycobacterium leprae cosmid* which corresponds to pYUB18 with Sau3A partial digest fragment from the genome of *M. leprae* that starts at position 1,373,705 and extends to position 1,403,746. This sequence comprises the sequence of the *Mycobacterium leprae cosmid* MLCY 811 which corresponds to pYUB18 with Sau3A partial digest fragment of the genome of *M. leprae* deposited at the C. N. C. M. under the accession 2633 that starts at position 1,363,759 and extends to position 403,737 according to Cole et al. (2001, Nature, 1007-1011).

FIG. 10. Polynucleotidic sequence (SEQ ID NO: 651) of the *Mycobacterium lepare cosmid* which corresponds to pYUB18 with Sau3A partial digest fragment of the genome of *M. leprae* that starts at position 3,160,443 and extends to position 3,194,161. This sequence comprises the sequence of the *Mycobacterium lepare* cosmid MLCY 047 which corresponds to pYUB18 with Sau3A partial digest fragment of the genome of *M. leprae* deposited at the C. N. C. M. under the accession number 2632 that starts at position 3,160,458 and extends to position 3,194,087 according to Cole et al. (2001).

DETAILED DESCRIPTION OF THE INVENTION

Sequence Analysis of *M. leprae*

The complete genome sequence of *M. leprae* contains 3,268,203 bp, and has an average G+C content of 57.8%. These values are much lower than those reported for the *M. tuberculosis* genome, comprising ~4,000 genes, 4,411,529 bp and 65.6% G+C (Cole et al, 1998). On detailed pairwise comparisons of both genome and proteome sequences (Cole et al., 1998; Tekaia, F., et al., Tubercle Lung Disease 79, 329-342, 1999), it was immediately apparent that only 49.5% of the genome was occupied by protein-coding genes, while 27% contained recognisable pseudogenes, inactive reading frames with functional counterparts in the tubercle *bacillus*. The remaining 23.5% of the genome did not appear to be coding, and probably contains gene remnants mutated beyond recognition. The distribution of the 1,114 pseudogenes was essentially random (FIG. 1) and, after their exclusion, 1604 potentially active genes remained, of which 1,439 were common to both pathogens. Among the remaining 165 genes, with no ortholog in *M. tuberculosis*, were 29 for which functions could be attributed. Many of the 136 residual CDS in *M. leprae*, showing no similarity to known genes, may also represent pseudogenes as they are shorter than average and occur in regions of low gene density (FIG. 1).

Reductive Evolution

Assuming that the genome of *M. leprae* was once topologically equivalent and similar in size to those of all other mycobacteria (~4.4 Mb) (Brosch, R., et al., Res. Microbiol., 151, 135-142, 2000; Philipp, W., et al., Electrophoresis, 19, 573-576, 1998; Stinear, T. P., et al., J. Bacteriol., 182, 6322-6330, 2000), then extensive downsizing and rearrangement must have occurred during evolution. Loss of 1.1 Mb would eliminate ~1100 CDS, and *M. leprae* would, therefore, be expected to produce 3000 proteins compared to the 4000 predicted in *M. tuberculosis*. On analysis of the proteome only 391 soluble protein species were detected (Marques, M. A. M., et al., Infection Immunity, 66, 2625-2631, 1998), compared to nearly 1800 in *M. tuberculosis* (Jungblut, P. R., et al., Mol Microbiol, 33, 1103-1117, 1999), consistent with there being many pseudogenes. In conclusion, since diverging from the last common mycobacterial ancestor, the leprosy *bacillus* may have lost >2000 genes.

Reductive evolution is documented in obligate intracellular parasites, such as *Rickettsia* and *Chlamydia* spp., and in some endosymbionts (Andersson, J. O., et al., Curr. Opin. Genetics & Development, 9, 664-671, 1999), as genes become inactivated once their functions are no longer required in highly specialised niches. This process may have naturally defined the minimal gene set for a pathogenic *mycobacterium*. The most extensive genome degradation reported previously was in *Rickettsia prowazekii*, the typhus agent, where only 76% of the potential coding capacity was used and 12 pseudogenes identified (Anderssen, S. G. E., et al., Nature, 396, 133-140, 1998). In comparison with *M. leprae*, the level of gene loss detected was modest, and it is striking that elimination of pseudogenes by deletion lags far behind gene inactivation in both pathogens. Intriguingly, the G+C content of *M. leprae* genes (60.1%) is higher than that of the pseudogenes (56.5%), and the remainder of the genome (54.5%). The high G+C content of *M. leprae*, and other mycobacteria, is apparently driven by the codon preference of active genes, while random mutation within non-coding regions results in drift towards a more neutral G+C content, closer to that of the host.

Mosaic Organization and Horizontal Transfer

While the precise mechanism behind pseudogene formation in *M. leprae* is unclear, loss of dnaQ-mediated proofreading activities of DNA polymerase III (Mizrahi, V., et al., eds. Hatfull, G. F. & Jacobs, W. R., Jr., 159-172 (ASM Press, Washington, D.C., 2000) may have contributed. By contrast, there is extensive evidence for large scale rearrangements and deletions arising from homologous recombination events. Comparison with *M. tuberculosis* delineated ~65 segments that show synteny but differ in their relative order and distribution in the *M. leprae* genome. Breaks in synteny generally correspond to dispersed repeats, tRNA genes or gene-poor regions. Copies of all three repeats, RLEP (SEQ ID NO: 653), REPLEP (SEQ ID NO: 654) and LEPREP (SEQ ID NO: 655), occur at the junctions of discontinuity suggesting that the mosaic arrangement of the *M. leprae* genome reflects multiple recombination events between related repetitive sequences. In some cases, aberrant recombination may have occurred as truncated repeats exist.

While there is little sequence similarity indicating that they are insertion sequences, RLEP (SEQ ID NO: 653) is clearly capable of transposition since it exists within sequences corresponding to known genes. Unlike *M. tuberculosis* H37Rv, which contains at least two prophages and 56 intact or truncated IS elements (Cole et al., 1998 ; Gordon, S. V., et al., Microbiology, 145, 881-892, 1999), *M. leprae* has only three phage-like genes, all with *M. tuberculosis* orthologs, and 26 transposase gene fragments. However, some signs of horizontal transfer of genetic material were detected when the aminoacyl-tRNA synthetase genes were examined. With one exception, all of these are more closely related to M. tuberculosis enzymes than to those of any other organism. Surprisingly, prolyl-tRNA synthetase, encoded by proS, is more similar to the enzymes of *Borrelia burgdorfieri* and eukaryotes such as *Drosophila*, humans and yeast. It has been proposed that horizontal transfer of tRNA synthetase genes occurs frequently, and that the pathogen *B. burgdorferi* may have acquired proS from its host (Wolf et al., 1999). Comparison of the genetic context provides further support for this hypothesis as the *M. leprae* pros is both displaced and inverted with respect to the *M. tuberculosis* genome (FIG. 4), consistent with recent acquisition.

Multigene Families

Half of the genes (52%) present in *M. tuberculosis* arose from gene duplication events leading to extensive functional redundancy (Tekaia et al., 1999). Many of these are involved in lipid metabolism or belong to the novel PE and PPE families, encoding unusual glycine-rich proteins of repetitive structure and unknown function. The latter are confined to certain mycobacterial species (Poulet, S., et al., Arch. Microbiol., 163, 79-86, 1995), and represent sources of genetic and, possibly antigenic, variation (Cole et al., 1998). The corresponding 167 genes are exceptionally GC-rich and occupy >8% of the *M. tuberculosis* genome (Cole, S. T., FEBS Letters, 452, 7-10, 1999). By contrast, only 9 intact PE and PPE genes were found in *M. leprae* although 30 pseudogenes were present. No intact members of the PE-PGRS subfamily were found. This reduction partly contributes to the smaller genome size and the lower GC content of *M. leprae*. Recently, some PE-PGRS proteins were shown to be upregulated in

*Mycobacterium marinum* during granuloma formation in frogs (Ramakrishnan, L., et al., Science, 288, 1436-1439, 2000). However, this effect is probably not mediated directly by the PE-PGRS, as granulomas are a prominent cytological feature of all forms of leprosy. Essentially all of the gene families (Tekaia et al., 1999) have undergone extensive retraction in *M. leprae* and now encode "just-enough" activity to permit intracellular growth. Selected examples of this are given in Table 1, whereas the comprehensive comparison presented in FIG. 3 shows that all functional categories have shrunk.

et al., Ann Microbiol (Paris), 133, 39-47, 1982) that in *M. tuberculosis* are introduced by MmaA2 and CmaA1. Since both the mmaA2 and cmaA1 genes have decayed in *M. leprae*, cyclopropanation must be encoded by one of the related umaA genes. Recently, both umaA2 and cmaA2 were shown to be essential for the cyclopropanation function in *M. tuberculosis* (Glickman, M. S., et al., Mol Cell, 5, 717-27, 2000). The same enzymes also catalyse cyclopropanation in *M. leprae* as their duplicate copies are both inactive (Table 1). Foremost among the outer lipids of the leprosy *bacillus* is phenolic glycolipid 1 (PGL1), an envelope component not found in *M.*

TABLE 1

Selected examples of metabolic streamlining

| *M. tuberculosis* Gene | *M. leprae* Gene | *M. leprae* Pseudogene | Function | Pathway |
|---|---|---|---|---|
| gltA1, gltA2, cit, 4 | gltA2 | citA | Citrate synthase | Krebs cycle |
| icd1, icd2 | icd2 | icd1 | Isocitrate dehydrogenase | Krebs cycle |
| icl, aceA | ace/A | icl | Isocitrate lyase | Glyoxylatecycle |
| gnd1, gnd2 | gnd1 | gnd2 | 6-phosphogluconate-dehydrogenase | Pentose phosphate pathway |
| pfkA, pjkB | pfkA | pfkB | Phospho-fructokinase | Glycolysis |
| aceE, lpdA, pdhA, pdhB, pdhC, lpd (Rv0462) | aceE, lpd (Rv0462) | lpdA, pdhA, dhB, pdhC | Pyruvate, dehydrogenase complex | Energy metabolism |
| lldD1, lldD2 | lldD2 | lldD1 | L-lactate dehydrogenase | Respiration |
| mmaA1, mmaA2, mmaA3, mmaA4, cmaA1, cmaA2, umaA1, umaA2 | mmaA1, mmaA4, cmaA2, umaA2 | mmaA2, nmaA3, cmaA1, umaA1 | Methyltransferase | Mycolic acid modification |
| glnA1, glnA2, glnA3, glnA4 | glnA1, glnA2 | glnA3, glnA4 | Glutamine synthase | Glutamine biosynthesis |
| metA, metB, metC, metE, metH, metK, metZ | met4, metB, metE, metH, metK, metZ | metC | Various | Methionine biosynthesis |
| bfrA, bfrB | bfrA | bfrB | Bacterioferritin | Iron storage |
| ligA, ligB, ligC | ligA | ligB | DNA ligase | DNA metabolism |

Metabolic Clues

Successive generations of microbiologists have failed to grow *M. leprae* in axenic culture leading to the notion that the bacterium lacks certain biosynthetic pathways. Complete genome comparisons shed new light on this. Lipid metabolism is prominent in the biochemical repertoire of *M. leprae* but to a lesser extent than in the tubercle *bacillus* whose cell envelope has a greater diversity of lipids, glycolipids and carbohydrates (Daffe, M., et al., Advances in Microbial Physiology, 39, 131-203, 1998).

Envelope Biogenesis

Mycolic acids, structural components of all mycobacteria, include the alpha mycolates, lacking oxygen functions, and the oxygenated keto- and methoxy-forms. Reappraisal of mycolic acid modification is now possible in the light of the reduced cmaA, mmaA and umaA gene-sets encoding the effector methyltransferases. *M. leprae* contains no methoxymycolates (Daff et al., 1998), probably due to the loss of the MmaA2 and MmaA3 enzymes that attach the methoxy group in *M. tuberculosis* (Brosch et al., 1999; Yuan, Y. et al., Proceedings of the National Academy of Sciences of the United States of America, 93, 12828-33, 1996). However, the mycolic acids do contain cyclopropane functions (Draper, P.,

*tuberculosis* (Melancon-Kaplan, J., et al., Proc. Nad. Acad. Sci. USA, 85, 1917-1921, 1988). PGL1 is derived from phthiocerol-dimycocerosate (PDIM), an esterified compound lipid generated by mycocerosic acid synthase and a type I polyketide synthase (PKS), by addition of three o-methylated deoxy sugars (Daffe et al., 1998). However, the genes for the glycosyltransferases, that modify PDIM to produce PGL1, could not be detected despite extensive comparisons. PDIM, a virulence factor in *M. tuberculosis*, requires the RND protein, MmpL7, for its transport across the cytoplasmic membrane (Tekaia et al., 1999 ; Cox, J. S., et al., Nature, 402, 79-83; 1999; Camacho, L. R., et al., Mol. Microbiol., 34, 257-267, 1999). Of the 18 PKS systems identifiable in *M. tuberculosis* (Cole et al., 1998), only six were predicted in *M. leprae* and the number of mmpL genes (often linked to PKS genes) has decreased from 16 to five, presumably because they are no longer required for polyketide or lipid export. Deletion of such systems may be reflected in the lack of mycolipenic and hydroxylipenic acids, polyketides esterified to trehalose in *M. tuberculosis*. Further PKS missing from *M. leprae* include the mbt operon required for production of the salicylate-based mycobactin siderophores. Lipids, polyketides and aromatic compounds are often substrates, for cytochrome-P450 monooxygenases (Peterson, J. A., et al., Structure, 6,1079-1085, 1998), enzymes that are exceptionally abundant in *M. tuberculosis* (Cole et al., 1998). Astonishingly, none of these is functional in *M. leprae* although a novel enzyme is predicted.

Lipolysis

Intracellular mycobacteria probably derive much of their energy from degradation of host-derived lipids (Wheeler, P. R., et al., eds. Bloom, B. R., 353-385, American Society for Microbiology, Washington D.C. 20005, 1994), a process initiated by lipases. In remarkable contrast to the 22 lip genes of *M. tuberculosis*, *M. leprae* has only two lipase genes, of which, lipG, clusters with mmaA genes and could, therefore, effect fatty acid remodelling. This appears to have just one lipase for scavenging fatty acids. The enzyme LipE (ML1190) or its counterpart in *M. tuberculosis* (Rv3775) could represent an attractive drug target. In addition to the multifunctional FadA and FadB enzymes, which catalyse β-oxidation, *M. tuberculosis* has numerous alternative systems for fatty acid degradation (Cole et al., 1998). Once again, *M. leprae* has roughly one third as many potential enzymes; however, there are three-times more FadD acyl-CoA synthases than FadE acyl-CoA dehydrogenases, whereas these are expected in equal amounts in *M. tuberculosis*. This may be explained by the dual role of FadD in β-oxidative and anabolic processes while FadE only participates catabolically.

The acetyl-CoA produced by β-oxidation, or glycolysis, flows into the central pathways of carbon metabolism in *M. leprae*. However, the pattern of "just enough" genes for each step is firmly established, so that the redundancy seen in *M. tuberculosis* almost never occurs. For instance, there is only one isocitrate lyase (with low predicted activity) capable of participating in the glyoxylate shunt (Table 1) (Honer Zu Bentrup, K., et al., Journal of Bacteriology, 181, 7161-7167, 1999 ; McKinney, J. D., et al., Nature, 406, 735-738, 2000), and one enzyme complex that oxidatively decarboxylates pyruvate to acetyl-CoA, compared to two such systems in *M. tuberculosis*. In the Krebs cycle, as in glycolysis, replicate genes for the same activity are deleted although differences in expression levels might compensate for some missing copies. Thus, while lack of pdh genes is reflected in a low rate of oxidative decarboxylation of pyruvate, isocitrate dehydrogenase activity is comparable in host-grown leprosy and tubercle bacilli (Wheeler, P. R., J Gen Microbiol, 130, 381-9, 1984) even though a duplicate icd gene is inactivated in *M. leprae*.

Central and Energy Metabolism

Despite an active glyoxylate cycle, there appear to be fundamental differences elsewhere in anaplerotic pathways between *M. leprae* and *M. tuberculosis*. Here, (PEP) carboxylase replaces the pyruvate carboxylase of *M. tuberculosis*, and the malic enzyme, associated with fast growth in mycobacteria (Ratledge, C. R., eds. Ratledge, C. & Stanford, J., 53-94, Academic Press Limited, San Diego, Calif., 1982), is missing. The metabolic implications are that flux between C3 and C4 compounds and the balance between glycolysis and gluconeogenesis will be very different. Another missing link between by-products of lipid metabolism and the Krebs cycle is the production of succinyl-CoA by catabolic Acc carboxylases predicted for *M. tuberculosis* et 1998). Other carbon sources lost to *M. leprae* are acetate, as ackA, pta and acs are all inactive, and galactose, so the cell wall galactan can only be produced from glucose since the galK, T genes are missing. This might imply that *M. leprae* is limited to growth on very few carbon sources, or even a limited and rather specialized combination, on which it can maintain a balanced carbon metabolism. Though a similar range of potential substrates is available to both *M. leprae* and *M. tuberculosis* in the host, marked differences in their ability to exploit them are apparent on examination of the systems involved in carbon and nitrogen compound degradation: there are fewer oxidoreductases, oxygenases and short-chain alcohol dehydrogenases, and their probable regulatory genes, (FIG. 3). The inescapable conclusion is that in *M. leprae* is severely limited.

In the same vein, the leprosy *bacillus* has lost anaerobic and microacrophilic electron transfer systems, such as formate dehydrogenase, nitrate, and fumarate reductase together with the biosynthetic and transport systems required to produce the cognate prosthetic groups. Likewise, the aerobic respiratory chain of *M. leprae* is truncated as only the 3'-end of the NADH oxidase operon, nuoA-N, remains. The consequences of this event are far-reaching, for not only has the potential to produce ATP from the oxidation of NADH been lost, but also regeneration of $NAD^+$ may be limited, relying heavily on ndh, which is involved only in recycling $NAD^+$. Alternatively, *M. leprae* may regenerate $NAD^+$ from NADH by (1) diverting pyruvate to acetate and $CO_2$ using lactate dehydrogenase and lactate oxidase; (2) diverting PEP to malate or fumarate via oxaloacetate, using its PEP carboxylase (an enzyme not found in the tubercle *bacillus*) that only catalyses the reaction in this direction. Given the loss of genes reviewed above, the acids produced by (1) and (2) cannot be recycled and must be excreted.

Anabolism

In surprising contrast, all the anabolic pathways seem to be relatively intact. With few exceptions, complete enzyme systems are predicted for synthesis of amino acids, purines, pyrimidines, nucleosides, nucleotides, most vitamins and cofactors. This suggests that the availability of these metabolites in phagosomes is either highly limited or that *M. leprae* cannot transport them efficiently. It also sets the biology of the leprosy *bacillus* apart from that of the other obligate parasites for which genomes have been sequenced (Andersson et al., 1999; Anderssen et al., 1998). *M., leprae* may, however, be auxotrophic for methionine as metC, encoding cystathionine β-lyase, is a pseudogene, whereas the other counterparts of *M. tuberculosis* met genes are all intact. This requirement for methionine may be dictated by the inactivation of the sulphate transport operon, cysYWA, and in turn this implies that *M. leprae* depends upon an organic source of sulphur. A second auxotrophy that is predicted is for cobinamide, as examination of the cob genes shows selective deletion of those to make cobinamide, while the genes needed to produce vitamin B12 from cobinamide are retained.

Pathogenesis and Disease Control

Central to a successful pathogenic lifestyle is the ability to obtain iron. *M. leprae* has many genes for haem and iron-based proteins and employs the iron regulatory systems, ideR and furB, yet may be severely handicapped compared to *M. tuberculosis* as it appears to have lost the mbt operon, encoding the non-ribosomal peptide synthase required for production of the iron-scavenging siderophores, mycobactin/exochelin (Cole et al., 1998 ; De Voss, J. J., et al., Proc. Natl.Acad. Sci. USA, 97, 1252-1257, 2000; Quadri, L. E., et al., Chemistry & Biology, 5, 631-645, 1998). However, part of the iron uptake system is functional in *M. leprae*, as it transports exochelinMN, from *M. neoaurum* but not those of *M. smegmatis* or *M. tuberculosis* (Hall, R. M., et al., Int J Lepr Other Mycobact Dis, 51, 490-494, 1983). The genes for exochelinMN are unknown and seem unlikely to occur in *M. leprae*.

As might be expected given the differences in their respective pathologies, *M. leprae* contains several enzymes that have no counterparts in the tubercle *bacillus*, including a eukaryotic-like uridine phosphorylase and adenylate cyclase. In addition, there are two transport systems that may play significant physiological roles: an ABC-transporter for sugars, and a second member of the Nrampl family, involved in divalent metal ion uptake. *M. leprae* may have acquired another Nrampl gene (Makui, H., et al., Molecular Microbiology, 35, 1065-1078, 2000) to ensure adequate intracellular iron concentrations resulting from its lack of mycobactin siderophores. *M. leprae*, shows a marked tropism for myelin-producing Schwann cells, and a surface-exposed 21 kDa laminin-binding protein (LBP) may be an important virulence factor (Shimoji, Y., et al., Proceedings of the National Academy of Sciences of the United States of America, 96, 9857-9862, 1999 ; Rambukkana, A., et al., Role of alpha-dystroglycan as a Schwann cell receptor for *Mycobacterium leprae*, 282, 2076-2079, 1998; Rambukkana, A., et al., Cell, 88, 811-821, 1997). Inspection of the genome sequence revealed a single LBP gene and this also occurs in *M. tuberculosis*. No further candidates for virulence genes were detected, and many of those present in *M. tuberculosis* have been inactivated or lost, including three of the Mce operons encoding putative invasins (Tekaia et al., 1999; Arruda, S., et al., Science, 261, 1454-1457, 1993). Although the leprosy and tubercle bacilli both survive within macrophages, *M. leprae* has no catalase-peroxidase (Eiglmeier, K., et al., FEMS Microbiol. Lett., 149, 273-278, 1997), and fewer per-oxidoxins and epoxide hydrolases to combat reactive oxygen species. It has retained both superoxide dismutases suggesting that these may contribute to its survival.

Comparative Mycobacterial Genomics

Comparative genomics is a powerful new tool for exploring micobial evolution and identifying those genes that might encode new drug targets or protective antigens. Coupled with knowledge derived from bioinformatic analysis of the proteome, and understanding of the underlying microbiology, it is possible to reduce the number of potential new targets within a pathogen to a more tangible level.

This invention includes discoveries resulting from the findings of a comparative analysis in which gene and protein sets of the leprosy and tubercle bacilli have been compared pair-wise, and against the completed genome sequences of various prokaryotes and eukaryotes.

The genome of *M. leprae*, an exceptionally slow growing bacterium, is substantially smaller than that of *M. tuberculosis* and contains numerous pseudogenes. While the genome of *M. tuberculosis* comprises 4.41 Mb and contains around 4,000 genes, the genome of *M. leprae* is only 3.27 Mb and a mere 49.5% is occupied by protein-coding genes. About 27% of the *M. leprae* genome contains recognizable pseudogenes, inactive reading frames with functional counterparts in the tubercle *bacillus*. The remaining 23.5% of the genome does not appear to be coding, and probably contains gene remnants mutated beyond recognition. The distribution of the 1,114 pseudogenes was essentially random throughout the chromosome. 1,604 potentially active genes were identified, of which 1,439 were common to both pathogens. Among the remaining 165 genes, with no ortholog in *M. tuberculosis*, were 29 for which functions could be attributed. Many of the 136 residual CDS in *M. leprae*, showing no similarity to known genes, may also represent pseudogenes as they are shorter than average and occur in regions of low gene density. In summary, assuming that all mycobacteria are descendants of a common ancestor, *M. leprae* has probably lost around 2,000 genes during evolution and the minimal gene set required by a pathogenic *mycobacterium* has been naturally defined.

Whole genome comparisons led to the identification of genes that are present in both *M. tuberculosis* and *M. leprae* but have no counterparts elsewhere. Since these pathogenic mycobacteria occupy similar niches in the human body where they encounter the same physiological stresses and immune responses, it is conceivable that the products of some of these genes may conduct highly specialized functions that could be essential for intracellular growth of mycobacteria. If this were the case, the corresponding proteins or enzymes might represent novel drug targets. In addition to those proteins that are confined to the species or the genus, there is a second group of polypeptides that also occur in Streptomyces spp., related members of the Actinomycetales kingdom, but not in other prokaryotes. It is reasonable to assume that such proteins confer specific properties on actinomycetes.

Knowledge of the subcellular location of proteins is particularly valuable for the design of new tuberculosis vaccines since it is widely believed that surface-exposed or secreted proteins correspond to those antigenic components that are first encountered by the immune system during infection (Andersen, P., Scandinavian Journal of Immunology, 45, 115-131, 1997). Bioinformatics has also been used to identify proteins that localize to the cell envelope and these include transmembrane proteins with hydrophobic domains, and lipoproteins with N-terminal cysteine residues that are modified by addition of lipid groups. Proteins that are secreted via the general secretory pathway (Pugsley, A. P., Microbiological Reviews, 57, 50-108, 1993) are readily identifiable by their characteristic signal peptides, whereas those metallo-enzymes that are secreted by the twin arginine transporter system, Tat, can be recognized by the presence at the N-terminus of the cognate motif, S/TRRXFLK (SEQ ID NO: 652) preceeding the signal peptide (Stanley, N. R., et al., J. Biol. Chem., 275, 11591-61, 2000; Berks, B. C., et al., Mol. Microbiol., 35, 260-274, 2000). This will be discussed further below.

Other proteins that lack signal peptides and are secreted from mycobacteria in a Sec-independent manner, include those belonging to the ESAT-6 family (Tekaia, F., et al., Tubercle Lung Disease, 79, 329-342, 1999). ESAT-6 is a potent T-cell antigen that induces strong Th1-type responses (Lalvani, A., et al., Proceedings of the National Academy of Sciences of the United States of America, 95, 270-275, 1998) and has been extensively studied as a potential diagnostic reagent for infection (Pollock, J. M. et al., J. Inf. Dis., 175, 1251-1254, 1997), since its gene is missing from BCG (Gordon, S. V., et al., Molec. Microbiol., 32, 643-656, 1999; Harboe, M., et al., Infection Immun., 64, 16-22, 1996; Mahairas, G. G., et al., J. Bacteriol., 178, 1274-1282, 1996) and as a component of a subunit vaccine (Brandt, L., et al., Infect Immun., 68, 791-795, 2000). The comparative genomic analysis identified several ESAT-6 proteins, and their potential secretion machinery, that were common to both *M. tuberculosis* and *M. leprae* (Table 2).

Several examples are given in Table 2 of proteins of limited distribution with potential drug targets, diagnostic antigens or subunit vaccine components.

Legend of Table 2:

The reading of the first example, by instance,

*M. leprae*

ML0048: Name of an identified ORF in the genome of *M. leprae*.

M. tub.:

Rv3876: Name of Equivalent ORF in the genome of *M. tuberculosis* published in 1998.

BLASTP:

Method of comparing protein sequences for establishing their degree of similarity or identity.

$1,00^E$-79:

BLASTP score, which indicates how similar the protein sequences are. The analyses of the results are described in Cole et al. for the comparisons between the genome of *M. tuberculosis* and the genome of BCG (Analysis of the proteome of *Mycobacterium tuberculosis* in silico, tuber Lung. Dis. 1999, 79(6):329-42).

Description:

Description of the protein, identified from all publically accessible databases, with highest similarity for the *M. leprae* protein ML0048.

Sc3C3.03C: Nomenclature of the streptomyces protein.

EMB: AL031231: Accession number in EMBL databank for the sequence of the Streptomyces protein found to be most similar to ML0048.

1083: length of the sequence in the EMBL databank.

FASTA score: Different method, like BLAST, for comparing sequences for their similarity.

Score denotes the degree of similarity.

31.6%: Percentage of identity between C terminal part of the Streptomyces protein and the amino acid sequence of ML0048. This 31.6% identity is found in an overlapping region of 580 amino acids between the two sequences. The other examples should be read similarly.

TABLE 2

Proteins of limited distribution with potential as drug targets, diagnostic antigens or subunit vaccine components

| Group | M. leprae | M. tub. | BLASTP | Description |
|---|---|---|---|---|
| A | ML0048 | Rv3876 | 1,00E−79 | C-terminal half of *Streptomyces coelicolor* SC3C3.03C, hypothetical protein, TR:O86637 (EMBL:AL031231) (1083 aa); Fasta score E( ): 5.9e−27, 31.6% identity in 580 aa overlap, which contains Pro-Gln repeats |
| A | ML0115 | Rv3780 | 2,00E−44 | *S. coelicolor* SCGD3.23C, hypothetical protein, TR:Q9XA56 (EMBL:AL096822) |
| A | ML0124 | Rv0164 | 2,00E−40 | *S. coelicolor* SC6G10.02C, hypothetical protein, TR:Q9X7Y8 (EMBL:AL049497) (144 aa); Fasta score E( ): 7e−05, 21.9% identity in 137 aa overlap. |
| A | ML0151 | Rv0948c | 2,00E−25 | *S. coelicolor* SCD63.16C, hypothetical protein, TR:CAB82023 (EMBL:AL161755) |
| A | ML0169 | Rv0966c | 7,00E−66 | *S. coelicolor* SCE6.30C, hypothetical protein, TR:CAB88834 (EMBL:AL353832) (277 aa); Fasta score E( ): 3.3e−20, 41.0% identity in 205 aa overlap. |
| A | ML0229 | Rv3603c | 2,00E−60 | N-terminal half of *S. coelicolor* SCE126.02C, hypothetical protein, TR:Q9X845 (EMBL:AL049630) (420 aa); Fasta score E( ): 4.1e−24, 36.7% identity in 294 aa overlap |
| A | lsr2 | Rv3597c | 1,00E−27 | *S. coelicolor* SCE94.26C, putative lsr2-like protein, TR:Q9X8N1 (EMBL:AL049628) (111 aa); Fasta score E( ): 7.3e−18, 56.3% identity in 112 aa overlap |
| A | ML0284 | Rv0360c | 3,00E−23 | *S. coelicolor* SCH10.25C, hypothetical protein, TR:Q9X8R4 (EMBL:AL049754) |
| A | whiB3 | Rv3416 | 6,00E−38 | Transcriptional regulator |
| A | lppS | Rv2518c | e−135 | many predicted lipoproteins from *S. coelicolor*. |
| A | ML0451 | Rv2609c | 2,00E−85 | *S. coelicolor* e.g. SC2E1.17, hypothetical protein, TR:O69888 (EMBL:AL023797) (172 aa); Fasta score E( ): 2e−13, 43.3% identity in 150 aa overlap. |
| A | ML0486 | Rv2588c | 2,00E−19 | *S. coelicolor* SCL2.07C, putative secreted protein, TR:CAB70919 (EMBL:AL137778) (169 aa); Fasta score E( ): 7.3e−08, 35.8% identity in 120 aa overlap |
| A | ML0542 | Rv1390 | 6,00E−51 | *S. coelicolor* SC9C5.02C, hypothetical protein, TR:CAB93358 (EMBL:AL357523) (90 aa); Fasta score E( ): 2e−18, 71.3% identity in 80 aa overlap. |
| A | ML0561 | Rv1417 | 3,00E−38 | *Corynebacterium ammoniagenes* ribX, hypothetical protein, TR:O24754 (EMBL:AB003693) (184 aa); Fasta score E( ): 2.1e−15, 34.5% identity in 148 aa overlap. Contains hydrophobic, possible membrane-spanning regions |
| A | ML0580 | Rv1446c | 2,00E−64 | hypothetical proteins from *S. coelicolor* e.g. SCC22.20, hypothetical protein, TR:Q9XAB8 (EMBL:AL096839) (351 aa); Fasta score E( ): 7.1e−21, 36.0% identity in 203 aa overlap, although these have a short N-terminal extension relative to this homologue. |
| A | ML0603 | Rv2413c | 3,00E−77 | *S. coelicolor* SCC123.02C, putative DNA-binding protein, TR:Q9RDM2 (EMBL:AL136518) (336 aa); Fasta score E( ): 0, 39.3% identity in 326 aa overlap. |
| A | ML0630 | Rv2365c | 2,00E−15 | *S. coelicolor* SCC77.05, hypothetical protein, TR:Q9RDF3 (EMBL:AL136503) (132 aa); Fasta score E( ): 3.3e−06, 39.4% identity in 99 aa overlap. |
| A | ML0642 | Rv3195 | e−143 | *S. coelicolor* SCE9.14C, hypothetical protein, TR:Q9X8I7 (EMBL:AL049841) (375 aa); Fasta score E( ): 4.9e−12, 24.9% identity in 305 aa overlap. |

TABLE 2-continued

Proteins of limited distribution with potential as drug targets, diagnostic antigens or subunit vaccine components

| Group | M. leprae | M. tub. | BLASTP | Description |
|---|---|---|---|---|
| A | whiB2 | Rv3260c | 9,00E−31 | Transcription factor |
| A | ML0762 | Rv3258c | 4,00E−41 | S. coelicolor hypothetical 15.0 kDa protein SCE34.11C TR:CAB88914 (EMBL:AL353862) fasta scores: E( ): 4.8e−16, 47.0% id in 151 aa |
| A | lpqB | Rv3244c | 0.0 | S. coelicolor putative lipoprotein SCE33.13C TR:CAB90922 (EMBL:AL355774) fasta scores: E( ): 0.00039, 24.4% id in 624 aa |
| A | whiB1 | Rv3219 | 6,00E−31 | Transcription factor |
| A | ML0814 | Rv3208c | 3,00E−32 | S. coelicolor hypothetical protein gp|AL390975|AL390975_32 (94 aa) E( ): 2.5e−09; 47.945% identity |
| A | ML0816 | Rv3207c | e−101 | S. coelicolor putative membrane protein SC2H12.28c (314 aa) TR:CAB94652 (EMBL:AL359215) fasta scores: E( ): 1e−13, 30.2% id in 331 aa |
| A | ML0857 | Rv2219 | 2,00E−59 | S. coelicolor putative integral membrane protein SC3H12.04 TR:CAB90843 (EMBL:AL355740) (234 aa) fasta scores: E( ): 1.2e−26, 39.6% id in 230 aa |
| A | ML0869 | Rv2206 | 4,00E−40 | S. coelicolor putative integral membrane protein SC5F7.32 TR:Q9S2R7 (EMBL:AL096872) |
| A | ML0876 | Rv2199c | 2,00E−43 | S. coelicolor hypothetical proteins e.g. putative integral membrane protein SC6G10.27C TR:Q9X812 (EMBL:AL049497) (132 aa) fasta scores: E( ): 6.2e−15, 38.8% id in 139 aa |
| A | ML0920 | Rv2147c | 3,00E−89 | pir|T34949 hypothetical protein SC4A10.12c - Streptomyces coelicolor |
| A | ML0921 | Rv2146c | 5,00E−32 | S. coelicolor TR:Q9S2X3 (EMBL:AL109663) (94 aa); Fasta score E( ): 2.9e−12, 40.7% identity in 86 aa overlap. Contains possible membrane spanning hydrophobia domains. |
| A | ML0986 | Rv2738c | 3,00E−21 | S. coelicolor TR:O50484 (EMBL:AL020958) (64 aa); Fasta score E( ): 2.5e−08, 44.4% identity in 63 aa overlap |
| A | ML0994 | Rv2728c | 1,00E−56 | S. coelicolor TR:O69964 (EMBL:AL022268) (237 aa); Fasta score E( ): 1.3e−13, 32.9% identity in 243 aa overlap |
| A | ML1009 | Rv2714 | e−106 | pir|T35742 hypothetical protein SC7H2.11C S. coelicolor |
| A | ML1016 | Rv2708c | 1,00E−25 | emb|CAB72193.1|(AL138851) hypothetical protein SCE59.06c [S. coelicolor A3 (2)] Length = 97 |
| A | ML1026 | Rv2699c | 2,00E−32 | T34816 hypothetical protein SC2E9.05 SC2E9.05 - S. coelicolor 144 2e−34 |
| A | ML1027 | Rv2698 | 1,00E−33 | membrane protein, S. coelicolor TR:O54132 (EMBL:AL021530) (154 aa); Fasta score E( ): 1.1e−08, 33.6% identity in 149 aa overlap. |
| A | ML1029 | Rv2696c | 7,00E−69 | pir|T34821 hypothetical protein SC2E9.10 SC2E9.10 - S. coelicolor 86 4e−16 |
| A | ML1041 | Rv2680 | 2,00E−62 | pir|T34710 hypothetical protein SC1C3.18c SC1C3.18C - S. coelicolor 158 5e−38 |
| A | ML1067 | Rv1211 | 9,00E−23 | emb|CAC01346.1| (AL390975) conserved hypothetical protein S. coelicolor 101 1e−21 |
| A | ML1093 | Rv1244 | 5,00E−78 | lipoprotein, pir|T35857 probable secreted substrate-binding protein - S. coelicolor 67 3e−10 |
| A | ML1105 | Rv1259 | e−115 | S. coelicolor TR:Q9S2L3 (EMBL:AL109732) (237 aa); Fasta score E( ): 0, 54.5% identity in 231 aa overlap. |
| A | ML1117 | Rv1276c | 3,00E−53 | pir|T36773 hypothetical protein SCI28.03c - S. coelicolor 115 4e−25 |
| A | ML1147 | Rv1312 | 3,00E−42 | possible secreted protein, emb|CAB94546.1| (AL359152) putative secreted/membrane protein S. coelicolor 66 2e−10 |
| A | ML1166 | Rv1332 | 7,00E−54 | S. coelicolor TR:Q9S2G6 (EMBL:AL096852) (202 aa); Fasta score E( ): 1.5e−05, 34.6% identity in 188 aa overlap. |
| A | ML1230 | Rv1182 | e−149 | papA3, emb|CAC08383.1| (AL392176) hypothetical protein S. coelicolor 132 8e−30 |
| A | ML1306 | Rv2125 | 5,00E−87 | S. coelicolor TR:Q9S2K6 (EMBL:AL109732) (312 aa); Fasta score E( ): 1.6e−07, 23.4% identity in 278 aa overlap |
| A | ML1321 | Rv2111c | 3,00E−07 | upstream of bacterial proteasome beta subunits including: Mycobacterium smegmatis TR:O30517 (EMBL:AF009645) (64 aa); Fasta score E( ): 6.2e−18, 82.8% identity in 64 aa overlap, Rhodococcus |
| A | ML1338 | Rv2673 | e−150 | conserved integral membrane protein, S. coelicolor TR:Q53873 (EMBL:AL031317) (411 aa); Fasta score E( ): 1.1e−12, 28.3% identity in 410 aa overlap |

TABLE 2-continued

Proteins of limited distribution with potential as drug targets, diagnostic antigens or subunit vaccine components

| Group | M. leprae | M. tub. | BLASTP | Description |
|---|---|---|---|---|
| A | ML1439 | Rv2050 | 4,00E−31 | emb|CAB61670.1| (AL133213) hypothetical protein SC6D7.18c. *S. coelicolor* 101 4e−21 |
| A | ML1485 | Rv2466c | 2,00E−66 | *S. coelicolor* TR:CAB71809 (EMBL:AL138662) (216 aa); Fasta score E( ): 0, 52.3% identity in 214 aa overlap |
| A | ML1508 | Rv1155 | 2,00E−48 | *S. coelicolor* TR:Q9XAG1 (EMBL:AL079356) (144 aa); Fasta score E( ): 5.6e−25, 54.3% identity in 140 aa overlap. |
| A | ML1525 | Rv2771c | 8,00E−27 | *S. coelicolor* TR:Q9RD46 (EMBL:AL133424) (151 aa); Fasta score E( ): 1.3e−28, 56.1% identity in 148 aa overlap |
| A | ML1548 | Rv2795c | e−132 | *S. coelicolor* TR:O88028 (EMBL:AL031107) (295 aa); Fasta score E( ): 0, 54.4% identity in 285 aa overlap |
| A | ML1557 | Rv2840c | 2,00E−27 | emb|CAB91141.1| (AL355913) hypothetical protean *S. coelicolor* 46 7e−05 |
| A | ML1561 | Rv2844 | 1,00E−39 | *S. coelicolor* TR:CAB91137 (EMBL:AL355913) (167 aa); Fasta score E( ): 1.4e−07, 35.8% identity in 137 aa |
| A | ML1624 | Rv2917 | 0.0 | *S. coelicolor* TR:Q9S3Y6 (EMBL:AF170560) (597 aa); Fasta score E( ): 0, 55.5% identity in 566 aa overlap |
| A | ML1644 | Rv2235 | e−113 | N-terminal signal sequence plus membrane spanning hydrophobia domain; emb|CAB59445.1| (AL132644) putative membrane protein [*Streptomyc* . . . 109 4e−23 |
| A | ML1649 | Rv2239c | 3,00E−36 | emb|CAB92846.1| (AL356892) hypothetical protein [*Streptomyces co* . . . 137 6e−32 |
| A | ML1652 | Rv2242 | 0.0 | *S. coelicolor* TR:Q9RDP8 (EMBL:AL133423) (401 aa); Fasta score E( ): 4.3e−26, 42.0% identity |
| A | ML1666 | Rv2968c | 9,00E−59 | *S. coelicolor* putative integral membrane protein TR:CAB93387 (EMBL:AL357523) (240 aa); Fasta score E( ): 3.6e−25, 36.1% identity in 191 aa overlap |
| A | ML1698 | Rv3005c | 4,00E−54 | conserved membrane protein, emb|CAB61735.1| (AL133220) putative membrane protein. *S. coelicolor* 99 5e−20 |
| A | ML1706 | Rv3015c | 1,00E−91 | *S. coelicolor* TR:Q9Z586 (EMBL:AL035569) (331 aa); Fasta score E( ): 0, 38.6% identity in 337 aa overlap, |
| A | ML1781 | Rv2256c | 4,00E−62 | 4pir| |T11215 hypothetical protein 5 - *Streptomyces glaucescens* > g . . . 153 1e−36 |
| A | ML1782 | Rv2257c | e−121 | *S. coelicolor* SC4A7.08 TR:Q9RDQ4 (EMBL:AL133423) (273 aa); Fasta score E( ): 0, 53.2% identity in 269 aa overlap |
| A | ML1791 | Rv1976c | 8,00E−25 | *S. coelicolor* hypothetical protein SC1C3.03C TR:O69845 (EMBL:AL023702) (125 aa); Fasta score E( ): 4.3e−06, 36.6% identity in 112 aa overlap. |
| A | ML1908 | Rv0637 | 3,00E−62 | *S. coelicolor* SCD82.07 TR:CAB77410 (EMBL:AL160431) (150 aa); Fasta score E( ): 4.7e−11, 29.3% identity in 150 aa overlap. |
| A | ML1910 | Rv0635 | 9,00E−49 | emb|CAB77410.1| (AL160431) hypothetical protein SCD82.07 *S. coelicolor* 83 1e−15 |
| A | ML1926 | Rv0431 | 6,00E−24 | *S. coelicolor* hypothetical protein SCD95A.20 TR:CAB93047 (EMBL:AL357432) (84 aa); Fasta score E( ): 4.1e−11 |
| A | ML1927 | Rv0430 | 2,00E−25 | *S. coelicolor* hypothetical protein SCD95A.20 TR:CAB93047 (EMBL:AL357432) (84 aa); Fasta score E( ): 4.1e−11, 52.8% identity in 72 aa overlap. |
| A | ML1997 | Rv0970 | 7,00E−39 | *S. coelicolor* putative integral membrane protein SCM2.15C |
| A | ML2030 | Rv1884c | 1,00E−34 | Rpf, emb|CAC09538.1| (AL442120) putative secreted protein *S. coelicolor* 108 5e−23 |
| A | ML2031 | Rv1883c | 1,00E−44 | *Streptomyces actuosus* NSH-OrfB TR:P72384 (EMBL:U75434) fasta scores: E( ): 2.5e−08, 34.4% in 125 aa |
| A | ML2048 | Rv1871c | 2,00E−14 | *S. coelicolor* hypothetical protein TR:CAB88434 (EMBL:AL353815) fasta scores: E( ): 0.0092, 39.3% in 61 aa; truncated at C-terminus; may represent a pseudogene |
| A | ML2063 | Rv1846c | 3,00E−35 | possible regulator, pir| |T36388 hypothetical protein SCE94.28C - *S. coelicolor* 64 6e−10 |
| A | ML2064 | Rv1845c | 3,00E−82 | *S. coelicolor* putative integral membrane protein SC10A7.04 TR:Q9XAS1 (EMBL:AL078618) fasta scores: E( ): 1.8e−19, 32.6% in 328 aa |
| A | ML2073 | Rv1830 | 2,00E−74 | *S. coelicolor* hypothetical 19.1 kda protein TR:CAB88877 (EMBL:AL353861) fasta scores: E( ): 3.7e−30, 64.8% in 145 aa |
| A | ML2075 | Rv1828 | 7,00E−71 | *S. coelicolor* hypothetical 26.5 kda protein TR:CAB88879 (EMBL:AL353861) fasta scores: E( ): 1.1e−14, 41.4% in 237 aa. |

TABLE 2-continued

Proteins of limited distribution with potential as drug targets, diagnostic antigens or subunit vaccine components

| Group | M. leprae | M. tub. | BLASTP | Description |
|---|---|---|---|---|
| A | ML2114 | Rv0909 | 7,00E−07 | S. coelicolor hypothetical 9.9 kda protein TR:O69965 (EMBL:AL022268) fasta scores: E( ): 0.038, 41.3% in 46 aa |
| A | ML2135 | Rv0885 | e−123 | S. coelicolor putative membrane protein TR:Q9XAE8 (EMBL:AL079356) fasta scores: E( ): 1.5e−13, 27.1% in 255 aa |
| A | ML2137 | Rv0883c | 1,00E−76 | S. coelicolor hypothetical 39.0 kda protein TR:O50529 (EMBL:AL009204) fasta scores: E( ): 2.2e−19, 36.0% in 247 aa |
| A | ML2142 | Rv0877 | 8,00E−91 | S. coelicolor hypothetical 32.2 kda protein TR:CAB93404 (EMBL:AL357524) fasta scores: E( ): 2.5e−19, 43.3% in 270 aa. |
| A | ML2143 | Rv0876c | e−172 | S. coelicolor putative integral membrane protein TR:CAB93403 (EMBL:AL357524) fasta scores: E( ): 5.3e−16, 38.8% in 448 aa. |
| A | ML2151 | Rv0867c | 1,00E−35 | Probable resusicitation-promoting factors, exported protein |
| A | ML2156 | Rv0862c | 0.0 | S. coelicolor hypothetical 90.4 kda protein TR:CAB93395 (EMBL:AL357524) fasta scores: E( ): 3.9e−27, 34.6% in 856 aa |
| A | ML2193 | Rv0819 | 2,00E−87 | Acetyltransferase (GNAT) family, emb|CAB88484.1| (AL353816) putative acetyltransferase S. coelicolor 216 3e−55 |
| A | ML2199 | Rv3118 | 1,00E−28 | Saccharopolyspora erythraea hypothetical 10.2 kda protein TR:Q54084 (EMBL:M29612) fasta scores: E( ): 2.7e−16, 53.0% in 100 aa |
| A | ML2200 | Rv0813c | 3,00E−59 | S. coelicolor hypothetical 21.7 kda protein TR:CAB94083 (EMBL:AL358692) fasta scores: E( ): 4.4e−11, 30.5% in 167 aa |
| A | ML2204 | Rv0810c | 2,00E−13 | S. coelicolor hypothetical 9.3 kda protein SCD25.24C TR:Q9RKJ8 (EMBL:AL118514) fasta scores: E( ): 1.3e−06, 46.8% id in 62 aa. |
| A | ML2207 | Rv0807 | 8,00E−36 | S. coelicolor hypothetical protein SCD25.20 TR:Q9RKKO (EMBL:AL118514) (202 aa) fasta scores: E( ): 6.6e−16, 52.5% id in 101 aa. |
| A | ML2219A | Rv0787A | 1,00E−33 | S. coelicolor hypothetical protein SCD25.13 (AL118514) |
| A | ML2253 | Rv2145c | 1,00E−06 | antigen 84 homolog, also in S. coelicolor, etc. |
| A | ML2261 | Rv0546c | 1,00E−43 | emb|CAB95979.1| (AL360034) conserved hypothetical protein S. coelicolor 119 1e−26 |
| A | ML2289 | Rv3662c | 7,00E−64 | S. coelicolor putative oxidoreductase SCH5.22C TR:Q9X924 (EMBL:AL035636) (274 aa) fasta scores: E ( ): 1e−11, 40.9% id in 269 aa |
| A | ML2295 | Rv3668c | 7,00E−67 | emb|CAB61552.1| (AL133171) protease precursor S. coelicolor 53 2e−06 |
| A | ML2296 | Rv3669 | 2,00E−43 | Similar to S. coelicolor putative integral membrane transport protein SCH5.28 TR:Q9X930 (EMBL:AL035636) (162 aa) fasta scores: E( ): 3.3e−10, 37.3% id |
| A | ML2306 | Rv3680 | e−110 | S. coelicolor putative ion-transporting ATPase TR:Q9XA35 (EMBL:AL079353) (481 aa) fasta scores: E( ): 0, 48.6% id in 432 aa |
| A | ML2307 | Rv3681c | 4,00E−28 | whiB4 |
| A | ML2330 | Rv3716c | 6,00E−10 | pir||T35387 hypothetical protein SC66T3.30c - S. coelicolor 47 6e−05 |
| A | ML2332 | Rv3718c | 1,00E−39 | S. coelicolor conserved hypothetical protein TR:Q9ZBJ2 (EMBL:AL035161) (147 aa) fasta scores: E( ): 1.4e−22, 47.6% id in 147 aa. |
| A | ML2410 | Rv0528 | e−160 | conserved membrane protein, emb|CAC08381.1| (AL392176) putative integral membrane protein S. coelicolor 221 2e−56 |
| A | ML2425 | Rv0504c | 7,00E−52 | emb|CAB77410.1| (AL160431) hypothetical protein SCD82.07 [Strept . . . 73 2e−12 |
| A | ML2428A | Rv0500B | 6,00E−17 | Small, strongly basic, S. coelicolor SCE68.25C, gp|AL079345|AL079345 25 S. coelicolor (32 aa) E( ): 1.7e−07; 93.103% |
| A | ML2432 | Rv0498 | e−101 | S. coelicolor hypothetical protein TR:Q9X8H0 (EMBL:AL049819) (285 aa) fasta scores: E( ): 3.2e−30, 51.6% id in 273 aa |
| A | ML2435 | Rv0495c | 7,00E−94 | S. coelicolor hypothetical protein TR:Q9X8H2 (EMBL:AL049819) (271 aa) fasta scores: E( ): 0, 48.4% id in 250 aa |
| A | ML2442 | Rv0487 | 1,00E−47 | emb|CAC04041.1| (AL391406) conserved hypothetical protein S. coelicolor 142 2e−33 |

TABLE 2-continued

Proteins of limited distribution with potential as drug targets, diagnostic antigens or subunit vaccine components

| Group | M. leprae | M. tub. | BLASTP | Description |
|---|---|---|---|---|
| A | ML2446 | Rv0483 | e−137 | possible lipoprotein, S. coelicolor putative lipoprotein TR:CAB76012 (EMBL:AL157916) fasta scores: E( ): 2.5e−24, 28.6% id in 405 aa. |
| A | ML2453 | Rv0476 | 9,00E−22 | conserved membrane protein, emb|CAC04036.1| (AL391406) putative membrane protein S. coelicolor 57 3e−08 |
| A | ML2522 | Rv0309 | 5,00E−65 | S. coelicolor putative secreted protein SCL24.08 TR:CAB76092 (EMBL:AL157956) |
| A | ML2529 | Rv0290 | e−116 | S. coelicolor putative integral membrane protein SC3C3.21 TR:O86654 (EMBL:AL031231) fasta scores: E( ): 1.9e−05, 23.8% id in 483 aa |
| A | ML2566 | Rv0241c | e−125 | S. coelicolor putative dehydratase TR:CAB77291 (EMBL:AL160312) |
| A | ML2630 | Rv0007 | 4,00E−06 | emb|CAB92992.1| (AL357152) putative integral membrane protein S. coelicolor 69 5e−11 |
| A | ML2640 | Rv0146 | 3,00E−93 | pir| |T35930 hypothetical protein SC9B5.10 - S. coelicolor 141 1e−32 |
| A | ML2664 | Rv0116c | 1,00E−72 | possible secreted protein, pir| |T35535 probable secreted protein - S. coelicolor 154 7e−37 |
| A | ML2687 | Rv0051 | e−150 | conserved membrane protein, pir| |T36589 probable transmembrane protein - S. coelicolor 185 1e−45 |
| A | ML2699 | Rv3909 | 0.0 | putative secreted protein, pir| |T36582 hypothetical protein SCH24.17c - S. coelicolor 90 8e−17 |
| M | ML0007 | Rv0007 | 6,00E−51 | Putative membrane protein |
| M | ML0012 | Rv0010c | 4,00E−30 | Contains hydrophobic, possible membrane-spanning regions. |
| M | ML0013 | Rv0011c | 3,00E−36 | Contains hydrophobic, possible membrane-spanning regions. |
| M | ML0022 | Rv0020c | e−114 | — |
| M | ML0030 | Rv0039c | 9,00E−06 | putative membrane protein |
| M | ML0031 | Rv0040c | 3,00E−48 | Contains a probable N-terminal signal sequence |
| M | ML0042 | Rv3882c | e−138 | putative membrane protein |
| M | ML0044 | Rv3880c | 2,00E−19 | — |
| M | ML0047 | Rv3877 | e−146 | putative membrane protein |
| M | ML0049 | Rv3875 | 5,00E−14 | possible secreted protein, ESAT-6 |
| M | ML0050 | Rv3874 | 4,00E−12 | possible secreted protein, ESAT-6 |
| M | ML0051 | Rv3873 | 1,00E−30 | PPE-family protein |
| M | ML0054 | Rv3869 | e−151 | putative membrane protein |
| M | ML0056 | Rv3867 | 2,00E−13 | — |
| M | ML0068 | Rv3850 | 8,00E−71 | — |
| M | ML0069 | Rv3849 | 4,00E−41 | — |
| M | ML0071 | Rv3847 | 2,00E−65 | — |
| M | ML0073 | Rv3843c | 3,00E−51 | putative membrane protein |
| M | ML0081 | Rv3835 | e−107 | putative membrane protein, possible membrane-spanning region near the N-terminus. |
| M | ML0091 | Rv3810 | 1,00E−39 | erp, pirG, exported repetitive protein precursor |
| M | ML0093 | Rv3808c | 0.0 | — |
| M | ML0094 | Rv3807c | 6,00E−30 | putative membrane protein |
| M | ML0096 | Rv3805c | 0.0 | putative membrane protein |
| M | ML0099 | Rv3802c | 8,00E−96 | — |
| H | embB | Rv3795 | 0.0 | arabinosyl transferase |
| M | embA | Rv3794 | 0.0 | arabinosyl transferase |
| M | embC | Rv3793 | 0.0 | arabinosyl transferase |
| M | ML0107 | Rv3792 | 0.0 | Mycobacterium smegmatis ORF3, hypothetical membrane protein |
| M | ML0116 | Rv3779 | e−179 | putative membrane protein |
| M | ML0133 | Rv2949c | 3,00E−64 | Pfam match to entry PF01947 DUF98, Protein of unknown function |
| M | lppX | Rv2945c | 6,00E−60 | putative lipoprotein |
| M | ML0158 | Rv0954 | 4,00E−20 | 34 kDa antigen, membrane protein |
| M | ML0159 | Rv0955 | 2,00E−74 | putative membrane protein |
| M | ML0185 | Rv0996 | 2,00E−74 | possible membrane-spanning regions |
| M | ML0187 | Rv0998 | e−124 | Cyclic nucleotide-binding domain. |
| M | ML0199 | Rv3647c | 2,00E−52 | — |
| M | ML0208 | Rv3632 | 2,00E−38 | putative membrane protein |
| M | ML0227 | Rv3605c | 3,00E−36 | putative membrane protein |
| M | MML0228 | Rv3604c | 2,00E−51 | putative membrane protein |
| M | lpqT | Rv1016c | 1,00E−52 | putative lipoprotein |
| M | ML0256 | Rv1024 | 2,00E−42 | Contains hydrophobic, possible membrane-spanning region |
| M | ML0271 | Rv0401 | 1,00E−23 | putative membrane protein |
| M | ML0279 | Rv0356c | 9,00E−63 | — |
| M | ML0281 | Rv0358 | 2,00E−36 | — |
| M | ML0285 | Rv0361 | 1,00E−50 | putative membrane protein |
| M | ML0298 | Rv0416 | 5,00E−10 | possibly thiamine biosynthesis |

TABLE 2-continued

Proteins of limited distribution with potential as drug targets, diagnostic antigens or subunit vaccine components

| Group | M. leprae | M. tub. | BLASTP | Description |
|---|---|---|---|---|
| M | lpqE | Rv3584 | 3,00E−40 | putative lipoprotein |
| M | ML0370 | Rv3438 | 2,00E−78 | Contains PS00107 Protein kinases ATP-binding region signature |
| M | ML0383 | Rv3415c | 5,00E−59 | — |
| M | ML0386 | Rv3412 | 4,00E−45 | — |
| M | ML0405 | Rv3616c | 1,00E−71 | — |
| M | ML0406 | Rv3615c | 2,00E−14 | — |
| M | ML0407 | Rv3614c | 2,00E−45 | — |
| M | ML0410 | Rv2107 | 8,00E−08 | PE-family protein |
| M | ML0411 | Rv2108 | 1,00E−22 | PPE-family protein, serine-rich antigen |
| M | ML0425 | Rv2520c | 2,00E−10 | putative membrane protein |
| M | ML0431 | Rv2507 | 1,00E−41 | putative membrane protein |
| M | ML0520 | Rv2536 | 1,00E−40 | putative membrane protein |
| M | PE | Rv1386 | 1,00E−21 | PE protein family. |
| M | PPE.0 | Rv1387 | 3,00E−99 | PPE protein family |
| M | mihF | Rv1388 | 4,00E−24 | integration host factor |
| M | lprG | Rv1411c | 1,00E−50 | putative lipoprotein |
| M | mtb12 | Rv2376c | 2,00E−28 | putative secreted protein |
| M | ML0676 | Rv3354 | 2,00E−15 | — |
| M | ML0703 | Rv3311 | e−125 | — |
| M | ML0730 | Rv3281 | 1,00E−20 | Contains Pfam match to entry PF01039 Carboxyl_trans, Carboxyl transferase domain |
| M | ML0733 | Rv3278c | 4,00E−53 | putative membrane protein |
| M | ML0734 | Rv3277 | 2,00E−64 | putative membrane protein |
| M | ML0748 | Rv3269 | 1,00E−15 | irpA |
| M | ML0761 | Rv3259 | 2,00E−48 | Mycobacterium smegmatis hypothetical 6.0 kDa protein (partial CDS) TR:Q9S425 (EMBL:AF164439) fasta scores: E( ): 1e−10, 75.5% id in 53 aa |
| M | ML0764 | Rv3256c | 1,00E−79 | — |
| M | ML0806 | Rv3217c | 5,00E−25 | putative membrane protein |
| M | ML0810 | Rv3212 | e−104 | putative membrane protein |
| M | ML0813 | Rv3209 | 2,00E−24 | putative membrane protein |
| M | ML0818 | Rv3205c | e−102 | — |
| M | ML0834 | Rv2342 | 1,00E−21 | — |
| M | ML0872 | Rv2203 | 9,00E−43 | putative membrane protein |
| M | mmpS3 | Rv2198c | 3,00E−49 | putative membrane protein |
| M | ML0878 | Rv2197c | 1,00E−55 | putative membrane protein |
| M | ML0888 | Rv2186c | 8,00E−41 | — |
| M | ML0889 | Rv2185c | 8,00E−41 | — |
| M | ML0891 | Rv2183c | 2,00E−27 | — |
| M | ML0895 | Rv2179c | 1,00E−60 | — |
| M | ML0898 | Rv2175c | 1,00E−41 | putative DNA-binding protein |
| M | MML0901 | Rv2172c | e−102 | — |
| M | ML0902 | Rv2171 | 3,00E−57 | probable lipoprotein |
| M | ML0903 | Rv2170 | 9,00E−55 | — |
| M | ML0904 | Rv2169c | 7,00E−32 | putative membrane protein |
| M | ML0907 | Rv2164c | 2,00E−50 | putative conserved membrane protein |
| M | ML0923 | Rv2144c | 3,00E−07 | possible membrane protein |
| M | ML0984 | Rv2740 | 3,00E−31 | — |
| M | ML0990 | Rv2732c | 9,00E−46 | possible conserved membrane protein |
| M | ML1001 | Rv2722 | 7,00E−06 | — |
| M | ML1004 | Rv2719c | 1,00E−17 | possible conserved membrane protein |
| M | ML1015 | Rv2709 | 1,00E−26 | possible conserved membrane protein |
| M | ML1025 | Rv2700 | 1,00E−62 | possible secreted protein |
| M | ML1030 | Rv2695 | 1,00E−47 | — |
| M | ML1053 | Rv2107 | 8,00E−11 | PE protein |
| M | ML1055 | Rv2347c | 1,00E−19 | —, family |
| M | ML1056 | Rv3619c | 6,00E−18 | —, family |
| M | ML1065 | Rv1209 | 6,00E−21 | membrane protein |
| M | ML1077 | Rv1222 | 3,00E−34 | Mycobacterium avium TR:O05736 (EMBL:U87308) (133 aa); Fasta score E( ): 0, 71.7% identity in 138 aa overlap |
| M | ML1079 | Rv1224 | 2,00E−29 | possible secreted protein |
| M | ML1096 | Rv1249c | 2,00E−48 | putative membrane protein |
| M | ML1098 | Rv1251c | 0.0 | some similarity to GTP-binding proteins |
| M | ML1099 | Rv1252c | 5,00E−41 | putative lipoprotein |
| M | ML1115 | Rv1274 | 3,00E−58 | lipoprotein, lprB |
| M | ML1116 | Rv1275 | 8,00E−54 | lipoprotein, lprC |
| M | ML1120 | Rv1278 | 0.0 | Contains multiple possible coiled-coils. Contains PS00017 ATP/GTP-binding site motif A (P-loop) |
| M | ML1138 | Rv1303 | 3,00E−20 | integral membrane protein |
| M | ML1176 | Rv1342c | 3,00E−34 | possible conserved membrane protein |
| M | ML1177 | Rv1343c | 5,00E−43 | possible lipoprotein, membrane protein |
| M | ML1180 | Rv3619c | 6,00E−18 | ESAT-6 family |
| M | ML1181 | Rv2347c | 1,00E−19 | QILSS family |

TABLE 2-continued

Proteins of limited distribution with potential as drug targets, diagnostic antigens or subunit vaccine components

| Group | M. leprae | M. tub. | BLASTP | Description |
|---|---|---|---|---|
| M | ML1182 | Rv1361c | 2.00E−47 | PPE family |
| M | ML1183 | Rv2107 | 8.00E−11 | PE family |
| M | ML1190 | Rv2525c | 3.00E−70 | —, twin-Arginine secreted protein |
| M | ML1221 | Rv1590 | 2.00E−18 | — |
| M | ML1222 | Rv1591 | 1.00E−29 | membrane protein |
| M | ML1232 | Rv1184c | 2.00E−77 | Possibly secreted PE protein, Contains PS00017 ATP/GTP-binding site motif A (P-loop) |
| M | ML1233 | Rv3821 | 9.00E−33 | conserved membrane protein |
| M | ML1244 | Rv2484c | e−130 | conserved membrane protein |
| M | ML1255 | Rv2468c | 1.00E−41 | — |
| M | ML1270 | Rv1610 | 8.00E−36 | conserved membrane protein, Contains Pfam match to entry PF00218 IGPS, |
| M | ML1296 | Rv2137c | 1.00E−25 | — |
| M | ML1299 | Rv2134c | 9.00E−60 | — |
| M | ML1300 | Rv2133c | 4.00E−90 | — |
| M | ML1315 | Rv2H6 | 1.00E−35 | lipoprotein, LppK |
| M | ML1334 | Rv2091c | 6.00E−28 | conserved membrane protein, calcium-binding |
| M | ML1357 | Rv1693 | 7.00E−09 | — |
| M | ML1361 | Rv1697 | e−114 | conserved membrane protein |
| M | ML1362 | Rv1698 | 6.00E−58 | conserved secreted protein |
| M | ML1389 | Rv1635c | e−144 | conserved membrane protein |
| M | ML1446 | Rv2061c | 5.00E−35 | — |
| M | ML1470 | Rv2446c | 2.00E−16 | conserved membrane protein |
| M | ML1505 | Rv1158c | 7.00E−17 | conserved hypothetical Proline rich protein, possibly secreted |
| M | ML1506 | Rv1157c | 4.00E−62 | — |
| M | ML1526 | Rv2772c | 2.00E−43 | conserved membrane protein |
| M | ML1537 | Rv1797 | 1.00E−98 | possible secreted protein |
| M | ML1S40 | Rv1794 | e−101 | — |
| M | ML1544 | Rv1782 | e−155 | conserved membrane protein |
| M | ML1560 | Rv2843 | 8.00E−24 | — |
| M | ML1584 | Rv2876 | 3.00E−25 | conserved membrane protein |
| M | ML1607 | Rv2898c | 2.00E−17 | Contains Pfam match to entry PF02021 UPF0102, Uncharacterised protein family UPF0102, sp\|083883\|Y913_TREPA HYPOTHETICAL PROTEIN TP0913 >gi\|7514634\|pir. |
| M | ML1610 | Rv2901c | 2.00E−39 | — |
| M | ML1638 | Rv2229c | 2.00E−63 | — |
| M | ML1677 | Rv2980 | 3.00E−33 | possible secreted protein |
| M | ML1704 | Rv3013 | 6.00E−71 | — |
| M | ML1720 | Rv3035 | e−107 | — |
| M | ML1813 | Rv1476 | 3.00E−39 | — |
| M | PPE.1 | Rv0256c | 3.00E−93 | PPE-family protein |
| M | ML1828A | Rv0257 | 1.00E−15 | Probably pseudogene as Rv0257 is longer |
| M | ML1911A | Rv0634A | | —, May be pseudogene as Rv0634A is predicted to be 13 aa longer |
| M | ML1918 | Rv3587c | 5.00E−69 | conserved hypothetical membrane protein |
| M | ML1937 | Rv1111c | 9.00E−39 | probable integral membrane protein |
| M | MML1939 | Rv1109c | 9.00E−49 | — |
| M | ML1945 | Rv1100 | 6.00E−57 | possible membrane protein |
| M | ML1991 | Rv0096 | 4.00E−90 | PPE |
| M | ML1988 | Rv0093c | 1.00E−52 | Contains possible membrane spanning hydrophobic domains. Note lacks the N-terminal 46 aa of the M. tuberculosis protein |
| M | ML1993 | Rv0098 | 3.00E−50 | — |
| M | ML1995 | Rv0100 | 1.00E−18 | — |
| M | ML2010 | Rv1906c | 4.00E−31 | putative lipoprotein (secreted in Mt) |
| M | ML2022 | Rv1893 | 2.00E−13 | — |
| M | ML2023 | Rv1891 | 2.00E−46 | Contains probable N-terminal signal sequence. |
| M | ML2054 | Rv1861 | 1.00E−07 | integral membrane protein |
| M | ML2070 | Rv1836c | e−171 | — |
| M | ML2111 | Rv0912 | 1.00E−35 | membrane protein |
| M | ML2113 | Rv0910 | 6.00E−49 | — |
| M | ML2141 | Rv0879c | 9.00E−22 | — |
| M | ML2144 | Rv0875c | 2.00E−45 | possible exported protein |
| M | ML2155 | Rv0863 | 2.00E−18 | — |
| M | ML2195 | Rv0817c | 4.00E−68 | probable exported protein |
| M | ML2228 | Rv0779c | 3.00E−50 | probable membrane protein |
| M | ML2258 | Rv0543c | 2.00E−28 | — |
| M | ML2259 | Rv0544c | 2.00E−16 | possible membrane protein |
| M | ML2271 | Rv0556 | 6.00E−46 | putative membrane protein |
| M | ML2274 | Rv0559c | 9.00E−23 | putative secreted protein |
| M | ML2320 | Rv3705c | 8.00E−64 | — |
| M | ML2337 | Rv3723 | 4.00E−S7 | possible membrane spanning hydrophobia domains |

TABLE 2-continued

Proteins of limited distribution with potential as drug targets, diagnostic antigens or subunit vaccine components

| Group | M. leprae | M. tub. | BLASTP | Description |
|---|---|---|---|---|
| M | ML2377 | Rv0451c | 1,00E−35 | mmpS4, *Mycobacterium avium* TmtpA TR:Q9XCF4 (EHBL:AF143772) (221 aa) fasta scores: E( ): 0, 58.9% id in 146 aa |
| M | ML2380 | Rv0455c | 2,00E−37 | possible secreted protein |
| M | ML2388 | Rv0463 | 9,00E−18 | possible membrane protein |
| M | ML2390 | Rv1083 | 1,00E−10 | possible secreted/membrane protein |
| M | ML2392 | Rv1081c | 6,00E−34 | conserved membrane protein, hydrophobic__stretch__from__aa__26-48 |
| M | ML2407 | Rv0531 | 5,00E−06 | putative membrane protein |
| M | ML2433 | Rv0497 | 5,00E−39 | conserved membrane protein |
| M | ML2450 | Rv0479c | 7,00E−57 | possible secreted protein, >gb|AAF74996.1|AF143402__1 (AF143402) putative multicopper oxidase [*Mycobacterium avium*] |
| M | ML2452 | Rv0477 | 2,00E−23 | — |
| M | ML2454 | Rv0475 | 6,00E−40 | possible hemagglutinin |
| M | ML2465 | Rv0464c | 7,00E−53 | — |
| M | ML2473 | Rv3753c | 2,00E−53 | — |
| M | ML2489 | Rv0383c | 5,00E−91 | possible secreted protein, hydrophobic N-terminus and Pro-rich C-terminus |
| M | ML2491 | Rv1754c | e−109 | — |
| M | ML2518 | Rv0313 | 1,00E−39 | — |
| M | ML2527 | Rv0292 | 2,00E−69 | conserved membrane protein, |
| M | ML2530 | Rv0289 | 2,00E−92 | — |
| M | ML2531 | Rv0288 | 5,00E−27 | ESAT-6 family, possible cell surface protein |
| M | ML2532 | Rv3020c | 9,00E−10 | PE-family protein |
| M | ML2534 | Rv0285 | 9,00E−13 | PE-family protein |
| M | ML2536 | Rv0283 | e−156 | conserved membrane protein |
| M | ML2557 | Rv0250c | 2,00E−26 | — |
| M | mce | Rv0169 | e−107 | Mce protein |
| M | ML2569A | Rv0236A | 2,00E−24 | Small secreted protein with typical N-terminal signal peptide |
| M | ML2570 | Rv0236c | 0.0 | possible integral membrane protein |
| M | ML2581 | Rv0227c | e−116 | putative integral membrane protein |
| M | ML2582 | Rv0226c | e−132 | conserved membrane protein |
| M | ML2595 | Rv0175 | 2,00E−41 | possible membrane protein |
| M | ML2596 | Rv0176 | 1,00E−73 | conserved membrane protein |
| M | ML2597 | Rv0177 | 1,00E−42 | conserved membrane protein |
| M | ML2598 | Rv0178 | 2,00E−43 | conserved membrane protein |
| M | ML2604 | Rv0184 | 8,00E−64 | — |
| M | ML2605 | Rv0185 | 3,00E−47 | — |
| M | ML2614 | Rv0199 | 3,00E−47 | conserved membrane protein |
| M | ML2615 | Rv0200 | 5,00E−55 | probable membrane protein |
| M | ML2616 | Rv0201c | 5,00E−36 | — |
| M | ML2621 | Rv0207c | 2,00E−43 | — |
| M | ML2627 | Rv0216 | e−103 | — |
| M | ML2629 | Rv0164 | 6,00E−44 | — |
| M | ML2689 | Rv0049 | 1,00E−45 | — |
| X | ML0190 | Rv1000 | 7,00E−53 | gp|AL357613|AL357613__12 *S. coelicolor* cosmid (210 aa) E( ): 2.4e−44; 55.122% identity in 205 aa overlap; AE003963|AE003963__5 *Xylella fastidiosa*, E( ): 9.7e−14; 3 9.894% identity in 188 aa overlap. Weak similarity to proteins involved in DNA repair |
| X | ML0257 | Rv1025 | 4,00E−72 | Also hypothetical proteins from *Thermotoga maritima* e.g. TM1078, hypothetical protein, TR:Q9XOG7 (EMBL:AE001768) (170 aa) |
| X | ML0418 | Rv3368c | 2,00E−76 | weak similarity *Thermus aquaticus* nox, NADH dehydrogenase, SW:NOX__THETH (X60110) (205 aa); Fasta score E( ): 0.00023, 28.8% identity in 212 aa overlap. |
| X | ML0577 | Rv1440 | 9,00E−12 | putative protein-export membrane protein, secG |
| X | ML0776 | Rv3242c | 3,00E−11 | probable competence protein ComF - *Deinococcus radio* . . . 77 2e−13 |
| X | ML1037 | Rv2683 | 2,00E−42 | Contains 2 Pfam matches to entry PF00571 CBS, CBS domain. |
| X | ML1119 | Rv1277 | e−105 | possibly phosphoesterase |
| X | ML1159 | Rv1324 | e−116 | probable thioredoxin |
| X | ML1249 | Rv2476c | 0.0 | *Rickettsia prowazekii* TR:Q9ZCI2 (EMBL:AJ235273) (1581 aa); Fasta score E( ): 0, 32.9% identity in 1494 aa overlap |
| X | ML1399 | Rv1647 | 1,00E−76 | weakly adenylate cyclases |
| X | ML1444 | Rv2054 | 3,00E−94 | Weakly several carboxymethylenebutenolidases (EC 3.1.1.45) involved in 3-chlorocatechol degradation e.g. *Pseudomonas putida* SW:CLCD__PSEPU (P11453) (236 aa) |

TABLE 2-continued

Proteins of limited distribution with potential as drug targets, diagnostic antigens or subunit vaccine components

| Group | M. leprae | M. tub. | BLASTP | Description |
|---|---|---|---|---|
| X | ML1494 | Rv1171 | 8,00E−19 | conserved membrane protein, pir\| \|PH0210 hypothetical protein 133 (fdxA 5' region) - *Saccharo* . . . 74 5e−13 |
| X | ML1503A | Rv1159A | 9,00E−33 | *S. coelicolor* (SC5C7.25) gp\|AL03151 5AL031515\|AL031515_25 (101 aa) E( ): 1.9e−06; 34.831% identity in 89 aa overlap; and archaebacteria. |
| X | ML1660 | Rv2926c | 2,00E−69 | —, pir\| \|E72412 conserved hypothetical protein - *Thermotoga maritime* . . . 66 4e−10 |
| X | ML1723 | Rv3038c | e−152 | —, gb\|AAC01738.1\| (AF040571) methyltransferase [*Amycolatopsis medit* . . . 59 1e−07 |
| X | ML1909 | Rv0636 | 9,00E−72 | Contains Pfam match to entry PF01575 MaoC_dehydratas, MaoC like domain. ML2566 |
| X | desA2 | Rv1094 | 7,00E−85 | *Gossypium hirsutum* (Upland cotton) acyl-[acyl-carrier protein] desaturase precursor SW:STAD_GOSHI (X95988) (397 aa); Fasta score E( ): 5.6e−05, 23.9% identity in 293 aa overlap. |
| X | ML1983 | Rv1919c | 8,00E−45 | weakly similar pollen allergen |
| X | ML2366 | Rv3760 | 1,00E−12 | *Deinococcus radiodurans* conserved hypothetical protein TR:Q9RU17 |
| X | ML2463 | Rv0466 | e−102 | weakly similar acyl-ACP thioesterase |

A, Actinomycete-specific;
M, mycobacterial-specific;
X, limited distribution;
—, no information available.

TABLE 3

Possible twin arginine secreted proteins

| M. tuberculosis | M. leprae | Gene | Predicted function |
|---|---|---|---|
| Rv0203 | del | — | unknown |
| Rv0265c | NF | fecB2 | iron_transport_protein_FeIII_dicitrate_transporter |
| Rv0846c | ML2171 ps | — | similar_to_several_L-ascorbate_oxidases |
| Rv1755c | del | plcD | phospholipase_C_precursor |
| Rv2349c | NF | plcC | phospholipase_C_precursor |
| Rv2350c | del | plcB | phospholipase_C_precursor |
| Rv2351c | NF | plcA | phospholipase_C_precursor |
| Rv2525c | ML1190 | — | unknown |
| Rv2577 | ML0497 ps | — | similarity to G755244 acid phosphatase |
| Rv2833c | del | ugpB | sn-glycerol-3-phosphate transport |
| Rv3353c | del | — | unknown |
| NF | ML2649 | — | unknown | del, deleted;
NF, not found;
ps, pseudogene.

The implications for this invention are widespread. *M. tuberculosis* and *M. leprae* marker polypeptide's are disclosed in SEQ ID NO: 1 to SEQ ID NO: 644. The discovery of the *M. tuberculosis* and *M. leprae* marker polypeptides and DNA encoding the polypeptides enables construction of expression vectors comprising nucleic acid sequences encoding *M. tuberculosis* and *M. leprae* marker polypeptides; host cells transfected or transformed with the expression vectors; biologically active *M. tuberculosis* and *M. leprae* marker polypeptides and *M. tuberculosis* and *M. leprae* marker polypeptides as isolated or purified peptides; and antibodies immunoreactive with *M. tuberculosis* and *M. leprae* marker polypeptides. In addition, understanding of the mechanism by which *M. tuberculosis* and *M. leprae* marker polypeptides function enables the design of assays to detect inhibitors of *M. tuberculosis* and *M. leprae* marker polypeptide activity.

As used herein, the term "*M. tuberculosis* and *M. leprae* marker polypeptides" refers to a genus of polypeptides that encompasses polypeptides of a formula selected from the group consisting of SEQ ID NO: 1 to SEQ ID NO: 644, as well as those polypeptides having a high degree of similarity (at least 90% homology) with such amino acid sequences and which polypeptides are immunoreactive or biologically active.

The term "purified" as used herein, means that the *M. tuberculosis* and *M. leprae* marker polypeptides are essentially free of association with other proteins or polypeptides, for example, as a purification product of recombinant host cell culture or as a purified product from a non-recombinant source. The term "substantially purified" as used herein, refers to a mixture that contains *M. tuberculosis* and *M. leprae* marker polypeptides and is essentially free of association with other proteins or polypeptides, but for the presence of known proteins that can be removed using a specific antibody, and which substantially purified *M. tuberculosis* and *M. leprae* marker polypeptides can be used as antigens.

A *M. tuberculosis* and *M. leprae* marker polypeptide "variant" as referred to herein means a polypeptide substantially homologous to native *M. tuberculosis* and *M. leprae* marker polypeptides, but which has an amino acid sequence different from that of native *M. tuberculosis* and *M. leprae* marker polypeptides because of one or more deletions, insertions, or substitutions. The variant amino acid sequence preferably is at least 80% identical to a native *M. tuberculosis* and *M. leprae* marker polypeptide amino acid sequence, most preferably at least 90% identical. The percent identity can be determined, for example by comparing sequence information using the GAP computer program, version 6.0 described by Devereux et al. (Nucl. Acids Res., 12:387, 1984) and available from the University of Wisconsin Genetics Computer Group (UWGCG). The GAP program utilizes the alignment method of Needleman and Wunsch (J. Mol. Biol. 48:443, 1970), as revised by Smith and Waterman (Adv. Appl. Math, 2:482, 1981). The preferred default parameters for the GAP program include: (1) a unary comparison matrix (containing a value of 1 for identities and 0 for non-identities) for nucleotides, and the weighted comparison matrix of Gribskov and Burgess, Nucl. Acids Res., 14:6745, 1986, as described by Schwartz and Dayhoff, eds., Atlas of Protein Sequence and Structure, National Biomedical Research Foundation, pp. 353-358, 1979; (2) a penalty of 3.0 for each gap and an additional 0.10 penalty for each symbol in each gap; and (3) no penalty for end gaps.

Variants can comprise conservatively substituted sequences, meaning that a given amino acid residue is replaced by a residue having similar physicochemical characteristics. Examples of conservative substitutions include substitution of one aliphatic residue for another, such as Ile, Val, Leu, or Ala for one another, or substitutions of one polar residue for another, such as between Lys and Arg; Glu and Asp; or Gln and Asn. Other such conservative substitutions, for example, substitutions of entire regions having similar hydrophobicity characteristics, are well known. Naturally occurring *M. tuberculosis* and *M. leprae* marker polypeptide variants are also encompassed by the invention. Examples of such variants are proteins that result from alternate mRNA splicing events or from proteolytic cleavage of the *M. tuberculosis* and *M. leprae* marker polypeptides. Variations attributable to proteolysis include, for example, differences in the termini upon expression in different types of host cells, due to proteolytic removal of one or more terminal amino acids from the *M. tuberculosis* and *M. leprae* marker polypeptides. Variations attributable to frameshifting include, for example, differences in the termini upon expression in different types of host cells due to different amino acids.

As stated above, the invention provides isolated and purified, or homogeneous, *M. tuberculosis* and *M. leprae* marker polypeptides, both recombinant and non-recombinant. Variants and derivatives of native *M. tuberculosis* and *M. leprae* marker polypeptides that can be used as antigens can be obtained by mutations of nucleotide sequences coding for native *M. tuberculosis* and *M. leprae* marker polypeptides. Alterations of the native amino acid sequence can be accomplished by any of a number of conventional methods. Mutations can be introduced at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion.

Alternatively, oligonucleotide directed, site specific mutagenesis procedures can be employed to provide an altered gene wherein predetermined codons can be altered by substitution, deletion, or insertion. Exemplary methods of making the alterations set forth above are disclosed by Walder et al. (Gene, 42:133, 1986); Bauer et al. (Gene, 37:73, 1985); Craik (BioTechniques, January 1985, 12-19); Smith et al. (Genetic Engineering: Principles and Methods, Plenum Press, 1981); Kunkel (Proc. Natl. Acad. Sci., USA, 82:488, 1985); Kunkel et al. (Methods in Enzymol., 154:367, 1987); and U.S. Pat. Nos. 4,518,584 and 4,737,462, all of which are incorporated by reference.

Within an aspect of the invention, *M. tuberculosis* and *M. leprae* marker polypeptides can be utilized to prepare antibodies that specifically bind to *M. tuberculosis* and *M. leprae* marker polypeptides. The term "antibodies" is meant to include polyclonal antibodies, monoclonal antibodies, fragments thereof such as F(ab')2 and Fab fragments, as well as any recombinantly produced binding partners. Antibodies are defined to be specifically binding if they bind *M. tuberculosis* and *M. leprae* marker polypeptides with a $K_a$ of greater than or equal to about $10^7$ $M^{-1}$. Affinities of binding partners or antibodies can be readily determined using conventional techniques, for example, those described by Scatchard et al., Ann. N.Y. Acad. Sci., 51:660, 1949). Polyclonal antibodies can be readily generated from a variety of sources, for example, horses, cows, goats, sheep, dogs, chickens, rabbits, mice, or rats, using procedures that are well known in the art.

The invention further encompasses isolated fragments and oligonucleotides derived from the nucleotide sequences of the invention. The invention also encompasses polypeptides encoded by these fragments and oligonucleotides.

Nucleic acid sequences within the scope of the invention include isolated DNA and RNA sequences that hybridize to the native *M. tuberculosis* and *M. leprae* marker nucleic acids disclosed herein under conditions of moderate or severe stringency, and which encode *M. tuberculosis* and *M. leprae* marker polypeptides. As used herein, conditions of moderate stringency, as known to those having ordinary skill in the art, and as defined by Sambrook et al. *Molecular Cloning: A Laboratory Manual*, 2 ed. Vol. 1, pp. 1.101-104, Cold Spring Harbor Laboratory Press, (1989), include use of a prewashing solution for the nitrocellulose filters 5×SSC, 0.5% SDS, 1.0 mM EDTA (pH 8.0), hybridization conditions of 50% formamide, 6×SSC at 42° C. (or other similar hybridization solution, such as Stark's solution, in 50% formamide at 42° C.), and washing conditions of about 60° C., 0.5×SSC, 0.1% SDS. Conditions of high stringency are defined as hybridization conditions as above, and with washing at 68° C., 0.2×SSC, 0.1% SDS. The skilled artisan will recognize that the temperature and wash solution salt concentration can be adjusted as necessary according to factors such as the length of the probe.

Due to the known degeneracy of the genetic code, wherein more than one codon can encode the same amino acid, a DNA sequence can vary and still encode a *M. tuberculosis* and *M. leprae* marker polypeptide of a formula selected from the group consisting of SEQ ID NO: 1 to SEQ ID NO: 644. Such variant DNA sequences can result from silent mutations (e.g., occurring during PCR amplification), or can be the product of deliberate mutagenesis of a native sequence.

The invention thus provides equivalent isolated DNA sequences, encoding *M. tuberculosis* and *M. leprae* marker polypeptides, selected from: (a) DNA derived from the coding region of a native *M. tuberculosis* and *M. leprae* marker nucleic acid; (b) cDNA comprising the nucleotide sequence of the invention; (c) DNA capable of hybridization to a DNA of (a) under conditions of moderate stringency and which encode *M. tuberculosis* and *M. leprae* marker polypeptides; and (d) DNA which is degenerate as a result of the genetic code to a DNA defined in (a), (b) or (c) and which encodes *M. tuberculosis* and *M. leprae* marker polypeptides. *M. tuberculosis* and *M. leprae* marker polypeptides encoded by such DNA equivalent sequences are encompassed by the invention.

DNA that is equivalent to the DNA sequence of the invention will hybridize under moderately stringent conditions to the double-stranded native DNA sequence that encodes polypeptides of a formula selected from the group consisting of SEQ ID NO: 1 to SEQ ID NO: 644. Examples of *M. tuberculosis* and *M. leprae* marker polypeptides encoded by such DNA, include, but are not limited to, *M. tuberculosis* and *M. leprae* marker polypeptide fragments and *M. tuberculosis* and *M. leprae* marker polypeptides comprising inactivated N-glycosylation site(s), inactivated protease processing site(s), or conservative amino acid substitution(s), as described above. *M. tuberculosis* and *M. leprae* marker polypeptides encoded by DNA derived from other species, wherein the DNA will hybridize to the complement of the DNA of the invention are also encompassed.

Recombinant expression vectors containing a nucleic acid sequence encoding *M. tuberculosis* and *M. leprae* marker polypeptides can be prepared using well known methods. The expression vectors include a *M. tuberculosis* and *M. leprae* marker DNA sequence operably linked to suitable transcriptional or translational regulatory nucleotide sequences, such as those derived from a mammalian, microbial, viral, or insect gene. Examples of regulatory sequences include transcriptional promoters, operators, or enhancers, an mRNA ribosomal binding site, and appropriate sequences which control transcription and translation initiation and termination. Nucleotide sequences are "operably linked" when the regulatory sequence functionally relates to the *M. tuberculosis* and *M. leprae* marker DNA sequence. Thus, a promoter nucleotide sequence is operably linked to a *M. tuberculosis* and *M. leprae* marker DNA sequence if the promoter nucleotide sequence controls the transcription of the *M. tuberculosis* and *M. leprae* marker DNA sequence. The ability to replicate in the desired host cells, usually conferred by an origin of replication, and a selection gene by which transformants are identified can additionally be incorporated into the expression vector.

In addition, sequences encoding appropriate signal peptides that are not naturally associated with *M. tuberculosis* and *M. leprae* marker polypeptides can be incorporated into expression vectors. For example, a DNA sequence for a signal peptide (secretory leader) can be fused in-frame to the *M. tuberculosis* and *M. leprae* marker nucleotide sequence so that the *M. tuberculosis* and *M. leprae* marker polypeptide is initially translated as a fusion protein comprising the signal peptide. A signal peptide that is functional in the intended host cells enhances extracellular secretion of the *M. tuberculosis* and *M. leprae* marker polypeptide. The signal peptide can be cleaved from the *M. tuberculosis* and *M. leprae* marker polypeptide upon secretion of the marker polypeptide from the cell.

Expression vectors for use in prokaryotic host cells generally comprise one or more phenotypic selectable marker genes. A phenotypic selectable marker gene is, for example, a gene encoding a protein that confers antibiotic resistance or that supplies an autotrophic requirement. Examples of useful expression vectors for prokaryotic host cells include those derived from commercially available plasmids. Commercially available vectors include those that are specifically designed for the expression of proteins. These include pMAL-p2 and pMAL-c2 vectors, which are used for the expression of proteins fused to maltose binding protein (New England Biolabs, Beverly, Mass., USA).

Promoter sequences commonly used for recombinant prokaryotic host cell expression vectors include β-lactamase (penicillinase), lactose promoter system (Chang et al., Nature, 275:615, 1978; and Goeddel et al., Nature, 281:544, 1979), tryptophan (trp) promoter system (Goeddel et al., Nucl. Acids Res., 8:4057, 1980; and EP-A-36776), and tac promoter (Maniatis, Molecular Cloning: A Laboratory Manual, Cold Spring Harbor Laboratory, p. 412, 1982).

Suitable host cells for expression of *M. tuberculosis* and *M. leprae* marker polypeptides include prokaryotes, yeast or higher eukaryotic cells. Appropriate cloning and expression vectors for use with bacterial, fungal, yeast, and mammalian cellular hosts are described, for example, in Pouwels et al., Cloning Vectors: A Laboratory Manual, Elsevier, New York, (1985). Cell-free translation systems could also be employed to produce *M. tuberculosis* and *M. leprae* marker polypeptides using RNAs derived from DNA constructs disclosed herein.

It will be understood that the present invention is intended to encompass the previously described proteins in isolated or purified form, whether obtained using the techniques described herein or other methods. In a preferred embodiment of this invention, the *M. tuberculosis* and *M. leprae* marker polypeptides are substantially free of human tissue and human tissue components, nucleic acids, extraneous proteins and lipids, and adventitious microorganisms, such as bacteria and a mycoplasma. It will also be understood that the invention encompasses equivalent proteins having substantially the same biological and immunogenic properties. Thus, this invention is intended to cover serotypic variants of the proteins of the invention.

Depending on the use to be made of the *M. tuberculosis* and *M. leprae* marker polypeptides of the invention, it may be desirable to label them. Examples of suitable labels are radioactive labels, enzymatic labels, fluorescent labels, chemiluminescent labels, and chromophores. The methods for labeling proteins and glycoproteins of the invention do not differ in essence from those widely used for labeling immunoglobulin. The need to label may be avoided by using labeled antibody to the antigen of the invention or anti-immunoglobulin to the antibodies to the antigen as an indirect marker.

Once the *M. tuberculosis* and *M. leprae* marker polypeptides of the invention have been obtained, they can be used to produce polyclonal and monoclonal antibodies reactive therewith. Thus, a polypeptide of the invention can be used to immunize an animal host by techniques known in the art. Such techniques usually involve inoculation, but they may involve other modes of administration. A sufficient amount of the polypeptide is administered to create an immunogenic response in the animal host. Any host that produces antibodies to the antigen of the invention can be used. Once the animal has been immunized and sufficient time has passed for it to begin producing antibodies to the antigen, polyclonal antibodies can be recovered. The general method comprises removing blood from the animal and separating the serum from the blood. The serum, which contains antibodies to the antigen, can be used as an antiserum to the antigen. Alternatively, the antibodies can be recovered from the serum. Affinity purification is a preferred technique for recovering purified polyclonal antibodies to the antigen from the serum.

Monoclonal antibodies to the antigens of the invention can also be prepared. One method for producing monoclonal antibodies reactive with the antigens comprises the steps of immunizing a host with the antigen; recovering antibody producing cells from the spleen of the host; fusing the antibody producing cells with myeloma cells deficient in the enzyme hypoxanthine-guanine phosphoribosyl transferase to form hybridomas; select at least one of the hybridomas by growth in a medium comprising hypoxanthine, aminopterin, and thymidine; identifying at least one of the hybridomas that produces an antibody to the antigen, culturing the identified hybridoma to produce antibody in a recoverable quantity; and recovering the antibodies produced by the cultured hybridoma.

These polyclonal or monoclonal antibodies can be used in a variety of applications. Among these is the neutralization of corresponding proteins. They can also be used to detect viral antigens in biological preparations or in purifying corresponding proteins, glycoproteins, or mixtures thereof, for example, when used in a affinity chromatographic columns.

The *M. tuberculosis* and *M. leprae* marker polypeptides can be used as antigens to identify antibodies to a mycobacteria in materials and to determine the concentration of the antibodies in those materials. Thus, the antigens can be used for qualitative or quantitative determination of a mycobacteria in a material. Such materials of course include human tissue and human cells, as well as biological fluids, such as human body fluids, including human sera. When used as a reagent in an immunoassay for determining the presence or concentration of the antibodies to a mycobacteria, the antigens of the present invention provide an assay that is convenient, rapid, sensitive, and specific.

More particularly, the antigens of the invention can be employed for the detection of a *mycobacterium* by means of immunoassays that are well known for use in detecting or quantifying humoral components in fluids. Thus, antigen-antibody interactions can be directly observed or determined by secondary reactions, such as precipitation or agglutination. In addition, immunoelectrophoresis techniques can also be employed. For example, the classic combination of electrophoresis in agar followed by reaction with anti-serum can be utilized, as well as two-dimensional electrophoresis, rocket electrophoresis, and immunolabeling of polyacrylamide gel patterns (Western Blot or immunoblot). Other immunoassays in which the antigens of the present invention can be employed include, but are not limited to, radioimmunoassay, competitive immunoprecipitation assay, enzyme immunoassay, and immunofluorescence assay. It will be understood that turbidimetric, colorimetric, and nephelometric techniques can be employed. An immunoassay based on Western Blot technique is preferred.

Immunoassays can be carried out by immobilizing one of the immunoreagents, either an antigen of the invention or an antibody of the invention to the antigen, on a carrier surface while retaining immunoreactivity of the reagent. The reciprocal immunoreagent can be unlabeled or labeled in such a manner that immunoreactivity is also retained. These techniques are especially suitable for use in enzyme immunoassays, such as enzyme linked immunosorbent assay (ELISA) and competitive inhibition enzyme immunoassay (CIEIA).

When either the antigen of the invention or antibody to the antigen is attached to a solid support, the support is usually a glass or plastic material. Plastic materials molded in the form of plates, tubes, beads, or disks are preferred. Examples of suitable plastic materials are polystyrene and polyvinyl chloride. If the immunoreagent does not readily bind to the solid support, a carrier material can be interposed between the reagent and the support. Examples of suitable carrier materials are proteins, such as bovine serum albumin, or chemical reagents, such as gluteraldehyde or urea. Coating of the solid phase can be carried out using conventional techniques.

The invention provides immunogenic *M. tuberculosis* and *M. leprae* marker polypeptides, and more particularly, protective polypeptides for use in the preparation of vaccine compositions against a *mycobacterium*. These polypeptides can thus be employed as viral vaccines by administering the polypeptides to a mammal susceptible to a mycobacteria infection. Conventional modes of administration can be employed. For example, administration can be carried out by oral, respiratory, or parenteral routes. Intradermal, subcutaneous, and intramuscular routes of administration are preferred when the vaccine is administered parenterally.

The major purpose of the immune response in a mycobacteria-infected mammal is to inactivate the free mycobacteria and to eliminate mycobacteria infected cells that have the potential to release infectious mycobacteria. The B-cell arm of the immune response has some responsibility for inactivating free mycobacteria. The principal manner in which this is achieved is by neutralization of infectivity. Another major mechanism for destruction of the a mycobacteria-infected cells is provided by cytotoxic T lymphocytes (CTL) that recognize *M. tuberculosis* and *M. leprae* marker antigens expressed in combination with class I histocompatibility antigens at the cell surface. The CTLs recognize *M. tuberculosis* and *M. leprae* marker polypeptides processed within cells from a *M. tuberculosis* and *M. leprae* marker polypeptide that is produced, for example, by the infected cell or that is internalized by a phagocytic cell. Thus, this invention can be employed to stimulate a B-cell response to M. tuberculosis and *M. leprae* marker polypeptides, as well as immunity mediated by a CTL response following infection. The CTL response can play an important role in mediating recovery from primary mycobacterial infection and in accelerating recovery during subsequent infections.

The ability of the *M. tuberculosis* and *M. leprae* marker polypeptides and vaccines of the invention to induce protective levels of neutralizing antibody in a host can be enhanced by emulsification with an adjuvant, incorporating in a liposome, coupling to a suitable carrier, or by combinations of these techniques. For example, the *M. tuberculosis* and *M. leprae* marker polypeptides of the invention can be administered with a conventional adjuvant, such as aluminum phosphate and aluminum hydroxide gel, in an amount sufficient to potentiate humoral or cell-mediated immune responses in the host. Similarly, the *M. tuberculosis* and *M. leprae* marker polypeptides can be bound to lipid membranes or incorporated in lipid membranes to form liposomes. The use of non-pyrogenic lipids free of nucleic acids and other extraneous matter can be employed for this purpose.

The immunization schedule will depend upon several factors, such as the susceptibility of the host to infection and the age of the host. A single dose of the vaccine of the invention can be administered to the host or a primary course of immunization can be followed in which several doses at intervals of time are administered. Subsequent doses used as boosters can be administered as needed following the primary course.

The *M. tuberculosis* and *M. leprae* marker polypeptides and vaccines of the invention can be administered to the host in an amount sufficient to prevent or inhibit a mycobacteria infection or replication in vivo. In any event, the amount administered should be at least sufficient to protect the host against substantial immunosuppression, even though a mycobacterial infection may not be entirely prevented. An immunogenic response can be obtained by administering the polypeptides of the invention to the host in an amount of about 10 to about 500 micrograms antigen per kilogram of body weight, preferably about 50 to about 100 micrograms antigen per kilogram of body weight. The polypeptides and vaccines of the invention can be administered together with a physiologically acceptable carrier. For example, a diluent, such as water or a saline solution, can be employed.

Another aspect of the invention provides a method of DNA vaccination. The method also includes administering any combination of the nucleic acids encoding *M. tuberculosis* and *M. leprae* marker polypeptides, with or without carrier molecules, to an individual. In embodiments, the individual is an animal, and is preferably a mammal. More preferably, the mammal is selected from the group consisting of a human, a dog, a cat, a bovine, a pig, and a horse. In an especially preferred embodiment, the mammal is a human.

The methods of treating include administering immunogenic compositions comprising *M. tuberculosis* and *M. leprae* marker polypeptides, but compositions comprising nucleic acids encoding *M. tuberculosis* and *M. leprae* marker polypeptides as well. Those of skill in the art are cognizant of the concept, application, and effectiveness of nucleic acid vaccines (e.g., DNA vaccines) and nucleic acid vaccine technology as well as protein and polypeptide based technologies. The nucleic acid based technology allows the administration of nucleic acids encoding *M. tuberculosis* and *M. leprae* marker polypeptides, naked or encapsulated, directly to tissues and cells without the need for production of encoded proteins prior to administration. The technology is based on the ability of these nucleic acids to be taken up by cells of the recipient organism and expressed to produce an immunogenic determinant to which the recipient's immune system responds. Typically, the expressed antigens are displayed on the surface of cells that have taken up and expressed the nucleic acids, but expression and export of the encoded antigens into the circulatory system of the recipient individual is also within the scope of the present invention. Such nucleic acid vaccine technology includes, but is not limited to, delivery of naked DNA and RNA and delivery of expression vectors encoding *M. tuberculosis* and *M. leprae* marker polypeptides. Although the technology is termed "vaccine", it is equally applicable to immunogenic compositions that do not result in a protective response. Such non-protection inducing compositions and methods are encompassed within the present invention.

Although it is within the present invention to deliver nucleic acids encoding *M. tuberculosis* and *M. leprae* marker polypeptides and carrier molecules as naked nucleic acid, the present invention also encompasses delivery of nucleic acids as part of larger or more complex compositions. Included among these delivery systems are *mycobacterium*, mycobacteria-like particles, or bacteria containing the nucleic acid encoding *M. tuberculosis* and *M. leprae* marker polypeptides. Also, complexes of the invention's nucleic acids and carrier molecules with cell permeabilizing compounds, such as liposomes, are included within the scope of the invention. Other compounds, such as molecular vectors (EP 696 191, Samain et al.) and delivery systems for nucleic acid vaccines are known to the skilled artisan and exemplified in, for example, WO 93/06223 and WO 90/11092, U.S. Pat. No. 5,580,859, and U.S. Pat. No. 5,589,466 (Vical's patents), which are incorporated by reference herein, and can be made and used without undue or excessive experimentation.

To further achieve the objective and in accordance with the purposes of the present invention, a kit capable of diagnosing mycobacteria infection is described. This kit, in one embodiment, contains the DNA sequences of this invention, which are capable of hybridizing to RNA or analogous DNA sequences to indicate the presence of a mycobacteria infection. Different diagnostic techniques can be used which include, but are not limited to: (1) Southern blot procedures to identify cellular DNA which may or may not be digested with restriction enzymes; (2) Northern blot techniques to identify RNA extracted from cells; and (3) dot blot techniques, i.e., direct filtration of the sample through an ad hoc membrane, such as nitrocellulose or nylon, without previous separation on agarose gel. Suitable material for dot blot technique could be obtained from body fluids including, but not limited to, serum and plasma, supernatants from culture cells, or cytoplasmic extracts obtained after cell lysis and removal of membranes and nuclei of the cells by centrifugation.

The invention also provides screening assays for identifying agents that modulate (e.g. augment or inhibit) the activity of *M. tuberculosis* and *M. leprae* marker polypeptides. Assays for detecting the ability of agents to inhibit or augment the activity of *M. tuberculosis* and *M. leprae* marker polypeptides provide for facile high-throughput screening of agent banks (e.g., compound libraries, peptide libraries, and the like) to identify antagonists or agonists of these marker polypeptides. Such *M. tuberculosis* and *M. leprae* marker polypeptide antagonists and agonists may modulate marker polypeptide activity and thereby modulate, inhibit, or even prevent infection of a host by *M. tuberculosis* and *M. leprae.*

For example, yeast comprising (1) an expression cassette encoding a GAL4 DNA binding domain (or GAL4 activator domain) fused to a binding fragment of *M. tuberculosis* or *M. leprae* marker polypeptide, (2) an expression cassette encoding a GAL4 DNA activator domain (or GAL4 binding domain, respectively) fused to a binding fragment of a test polypeptide, and (3) a reporter gene (e.g., β-galactosidase) comprising a cis-linked GAL4 transcriptional response element can be used for agent screening. Such yeast are incubated, and expression of the reporter gene (e.g., β-galactosidase) is determined by the capacity of the agent to affect expression of the reporter gene and thereby identify the test polypeptide as a candidate modulatory agent for *M. tuberculosis* or *M. leprae* marker polypeptides.

Yeast two-hybrid systems can be used to screen a mammalian (typically human) cDNA expression library, wherein cDNA is fused to a GAL4 DNA binding domain or activator domain, and either a *M. tuberculosis* or *M. leprae* marker polypeptide sequence is fused to a GAL4 activator domain or DNA binding domain, respectively. Such a yeast two-hybrid system can screen for cDNAs that encode proteins that interact with *M. tuberculosis* or *M. leprae* marker polypeptides.

Polypeptides that interact with *M. tuberculosis* or *M. leprae* marker polypeptides can also be identified by immunoprecipitation of *M. tuberculosis* or *M. leprae* marker polypeptides with antibody, and identification of co-precipitating species. Further, polypeptides that interact with *M. tuberculosis* or *M. leprae* marker polypeptides can be identified by screening a peptide library (e.g., a bacteriophage peptide display library) with a *M. tuberculosis* or *M. leprae* marker polypeptide.

Additional embodiments of the invention are directed to methods that employ specific antisense polynucleotides complementary to all or part of *M. tuberculosis* or *M. leprae* marker nucleic acids. Such complementary antisense polynucleotides may include nucleotide substitutions, additions, deletions, or transpositions, so long as specific hybridization to the relevant target sequence corresponding to *M. tuberculosis* or *M. leprae* marker nucleic acids is retained as a functional property of the polynucleotide. Complementary antisense polynucleotides include soluble antisense RNA or DNA oligonucleotides that can hybridize specifically to *M. tuberculosis* and *M. leprae* marker nucleic acid species and prevent transcription of the mRNA species and/or translation of the encoded polypeptide. See (Ching et al., 1989, *Proc.*

*Natl. Acad. Sci. U.S.A.*, 86:10006 ; Broder et al., 1990, Ann. Int. Med., 113:604; Loreau et al., 1990, FEBS Letters, 274: 53; Holcenberg et al., WO91/11535; U.S. Ser. No. 07/530, 165; WO 91/09865; WO 91/04753; WO 90/13641; and EP 386563). The antisense polynucleotides, therefore, inhibit production of *M. tuberculosis* or *M. leprae* marker polypeptides. Antisense polynucleotides that prevent transcription and/or translation of mRNA corresponding to *M. tuberculosis* or *M. leprae* marker polypeptides may inhibit or prevent infection by *M. tuberculosis* or *M. leprae*. Antisense polynucleotides of various lengths may be produced, although such antisense polynucleotides typically comprise a sequence of about at least 25 consecutive nucleotides, Which are substantially identical to a naturally-occurring *M. tuberculosis* or *M. leprae* marker nucleic acids, and typically are identical to a *M. tuberculosis* or *M. leprae* marker nucleic acid. For general methods relating to antisense polynucleotides, see *Antisense RNA and DNA*, (1988) D. A. Melton, Ed., Cold Spring Harbor Laboratory, Cold Spring Harbor, N.Y.).

Polypeptides with similar sequence should have similar function. Thus, the functions of *M. tuberculosis* and *M. leprae* marker polypeptides can be assessed by a database search. One method by which structural and functional domains can be identified is by comparison of the nucleotide and/or amino acid sequence data for *M. tuberculosis* and *M. leprae* marker polypeptides, or *M. tuberculosis* or *M. leprae* marker nucleic acids, to public or proprietary sequence databases. Preferably, computerized comparison methods are used to identify sequence motifs or predict polypeptide conformation domains that occur in other polypeptides of known structure and/or function. For example, methods to identify protein sequences that fold into a known three-dimensional structure are known (Bowie et al., 1991, Science, 253:164).

As other examples, but not for limitation, the programs GAP, BESTFIT, FASTA, and TFASTA in the Wisconsin Genetics Software Package (Genetics Computer Group, 575 Science Dr., Madison, Wis.) can be used to identify sequences in databases, such as GenBank/EMBL, that have regions of homology with *M. tuberculosis* or *M. leprae* marker polypeptides or *M. tuberculosis* or *M. leprae* marker nucleic acids. Such homologous regions are candidate structural or functional domains. Alternatively, other algorithms are provided for identifying such domains from sequence data. Further, network methods, whether implemented in hardware or software, can be used to: (1) identify related protein sequences and nucleotide sequences, and (2) define structural or functional domains in *M. tuberculosis* and *M. leprae* marker polypeptides.

Thus, those of skill in the art can recognize sequence motifs and structural conformations that may be used to define structural and functional domains in the *M. tuberculosis* and *M. leprae* marker nucleic acids of the invention. Hydrophobicity profiles can be generated and displayed graphically using the utility at ExPASy. There are a number of different ways of predicting transmembrane helices in sequences, the simplest being merely to look for regions of the protein containing a run of 20 hydrophobic residues. However, there are also a number of more sophisticated, and accurate, algorithms which can be used not only to predict the location of transmembrane helices but also their orientation in the membrane.

Proteins can contain signals within their sequence which assist in their processing within the cell, for example leader sequences or signals which target proteins to specific compartments within cells. Web resources are available to help predict both these types of sites. Different regions of a polypeptide evolve at different rates; some parts of a polypeptide must retain a certain pattern of residues for the polypeptide to function. By identifying such conserved regions, it is possible to make predictions about the polypeptide function. Examples of conserved sequences can be found around the active sites of enzymes, sites of post-translational modification, binding sites for co-factors, protein sorting signals, etc. A number of bioinformatics resources have been developed both to build databases of conserved patterns and to search for instances of such patterns in sequences. One of the best known motif databases is PROSITE, which can be employed in this invention.

This invention will be described in greater detail in the following Examples.

EXAMPLE 1

The whole genome sequence was obtained from a combination of sequenced cosmids (Eiglmeier, K., et al., Mol. Microbiol., 7,197-206, 1993) and 54,000 end sequences (giving 7.1× coverage) from a pUC18 genomic shotgun library using dye terminator chemistry on ABI373 or 377 automated sequencers. The sequences of 42 cosmids previously generated by multiplex sequencing (Smith, D. R., et al., Genome Research, 7, 802-819, 1997) were used for scaffolding purposes only. The sequence was assembled using Phrap (P. Green, unpublished), finished using GAP4 (Bonfield, J. K., et al., Nucleic Acids Res., 24, 4992-4999, 1995) then compared with sequences present in public databases using FASTA, BLASTN and BLASTX (Altschul, S. F., et al., Nature Genet., 6, 119-129, 1994). Potential CDS were predicted, and gene and protein sequences analysed as described previously (Cole et al., 1998; Parkhill, J., et al., Nature, 404, 502-505, 2000), using Artemis (Rutherford, K., et al., Bioinformatics, 16, 944-945, 2000) to collate data and facilitate annotation. The genome and proteome sequences of *M. leprae* and *M. tuberculosis* H37Rv were compared pairwise to identify conserved genes using the Artemis Comparison Tool (ACT) (K. Rutherford; unpublished; http://www.sanger.ac.uk/Software/ACT/). Pseudogenes had one or more mutations that would ablate expression and were pinpointed by direct comparison with *M. tuberculosis.*

EXAMPLE 2

Target Discovery

To illustrate the usefulness of comparative mycobacterial genomics for identifying potentially important proteins, a precise example will now be given. Preproteins transported by the TAT pathway generally bind redox cofactors and fold or oligomerize before crossing the membrane (Berks et al., 2000; Berks, B. C., et al., Biochim. Biophys. Acta., 1459, 325-330, 2000). After removal of the signal peptide, these proteins usually function in extracytoplasmic electron transfer chains. The specialized machinery that recognizes the twin-arginine motif, and translocates the preprotein across the membrane, is composed of several different Tat proteins. In *Escherichia coli*, TatA and TatE are 50% identical and share weak similarity with TatB. All three proteins are predicted to be anchored to the cytoplasmic membrane via an N-terminal hydrophobic alpha-helix, and to have cytoplasmic amphipathic helices followed by variable regions. The TatC protein is predicted to be an integral membrane protein with six transmembrane segments. *M. tuberculosis* and *M. leprae* both contain clearly identifiable tatA, tatB, tatC, and tatD genes and must, therefore, produce a functional Tat system.

On examination of the proteome of *M. tuberculosis*, eleven potential substrates for the Tat export system were recognized on the basis of their signal peptides containing potential twin arginine motifs (Table 3). During the extensive reductive evolution of the genome of *M. leprae* only one of the corresponding genes, ML1190, has escaped inactivation. It is orthologous to Rv2525c of *M. tuberculosis* but shows no similarity to proteins present in sequence databases. The 240 amino acid long precursor protein encoded by Rv2525c (or its counterpart ML1190 contains five histidines and one cysteine residue that may be important for coordinating divalent metal ions. The conservation of this coding sequence by *M. leprae*, in the face of massive gene loss, is a strong indication that it must play an important biological role. Given the many parallels with Tat systems elsewhere, it is likely to be in electron transport. These indirect arguments suggest on the one hand that, if this function were essential, the ML1190/Rv2525c gene product might represent a novel drug target or, on the other, since it is likely to be located extracellularly it may, therefore, be an important sentinel protein antigen.

The *Mycobacterium tuberculosis* strain HRV37 genomic library has been deposited at the Collection Nationale de Cultures de Microorganismes (C.N.C.M.), of Institut Pasteur, 28, rue du Docteur Roux, F-75724 Paris, Cedex 15, France, on Nov. 19, 1997, under the Accession Number I-1945. This genomic DNA library is disclosed in International patent application No. WO 9954487 (Institut Pasteur).

In summary, Leprosy, a chronic human neurological disease, results from infection with the obligate intracellular pathogen *Mycobacterium leprae*, a close relative of the tubercle *bacillus*. *M. leprae* has the longest doubling time of all known bacteria and has thwarted every effort at axenic culture. Comparison of the 3.27 Mb genome sequence of an armadillo-derived Indian isolate of the leprosy *bacillus* with that of *Mycobacterium tuberculosis* (4.41 Mb) provides clear explanations for these properties and reveals an extreme case of reductive evolution. Less than half of the genome contains functional genes while pseudogenes, with intact counterparts in *M. tuberculosis*, abound. Genome downsizing and the current mosaic arrangement appear to have resulted from extensive recombination events between dispersed repetitive sequences. Gene deletion and decay have eliminated many important metabolic activities including siderophore production, part of the oxidative, and all of the microaerophilic and anaerobic respiratory chains, together with numerous catabolic systems and their regulatory circuits.

The entire disclosure of each of the publication which has been referenced in the present description is incorporated by reference herein.

SEQUENCE LISTING (655 sequences)

SEQ ID NO: 1 - protein, 303 aa, Mycobacterium leprae
VTSPNESRAFNAADDLIGDGSVERAGLHRATSVPGESSEGLQRGHSPEPNDSPPWQRGSARASQSGYRPSDPLTTTRQSNPAPGANVRSNRFISGMTAPALSGQLPKKNNSTQALEPVLMSNEVPFTESYASELPDLSGPVQRTVPCKPSPDRGSSTPRMGRLEITKVRGTGEIRSQISRRSHGPVRASMQIRRIDPWSMLKVSLLLSVALFFVWMIAVAFLYLLLGGMGVWAKLNSNVGDLLNNTGGNSGELVSNSTIFGCAVLVGLVNIVLMTTMAAIAAFVYNLSSDLVGGVEVTLADLD

SEQ ID NO: 2 - protein, 137 aa, Mycobacterium leprae
MQQTAWGPRTARIAGCGGAGIVIAIACSTLDIDTPGFMLTGIAALGLILFAGLSWRARPKLAINPDGLAVQGWFRTRLFGPADIKIIRITEFRRFGRKVRLLEIEAINGDLVILSRWDLGTGPLEVLDALITAGYAG

SEQ ID NO: 3 - protein, 93 aa, Mycobacterium leprae
MPKSKVRKKNDFTITSVSRTPVKVKVGPSSVWFVTLFVGLMLIGLVWLMVFQLAALGTQAPTALHWMAQLGPWNYAIAFAFMITGLLLTMRWH

SEQ ID NO: 4 - protein, 488 aa, Mycobacterium leprae
MDNQKELIQRIERKLESSIDDAFARMFGGSIVPQEVEALLRREASDGVRSLQGNRLLAPNEYIITLGVHDLEKMKADPDLTSSAFASDLADYIHEQGWQTYGDVVVRFDQSSSLHTGQIRARSVVNPDVEPRPTVNDPVRTQSNQAFSAEPGVPPMTDNSSYRGGQGQGRPSDDYYGRPQDDPRGADPQGGQDPRGCYPPKPGSYPQQAGHPPLHRPDQGGYPGQGGYEDQRAYHDQGQGGYPSPYEQRPATPGGYGSQGHDQGYRPGSYGPPSGGQPGYGGYGDYGRGPARPDEGSYTPSGFPAPPEQRVAYPDQGGGYDQGYQHSGLGYGREDYGRQEYTQYAENLPGGVYAPSSGGYAEPAGRDYDYGQPGAANDYSQPVIGGYGGYGALGSAVILQLDDGSGRTYQLREGSNIVGRGQDAQFRLPDTGVSRRHLEIRWDGQVALLSDLNSTNGTTVNNAPVQEWQLADGDVIRLGHSEIIVRIH

SEQ ID NO: 5 - protein, 113 aa, Mycobacterium leprae
MLIAGTLCVCAAVISAVFGTWALIHNQTVDPTQLAMRAMAPPQLAAAIMLAAGGVVALVAVAHTALIVVAVCVTGAVGTLAAGSWQSARYTLRRRATATSCGKNCAGCILSCR

SEQ ID NO: 6 - protein, 278 aa, Mycobacterium leprae
MIQSTQTWRVLAGGLAATAMGVTVFAGGTAAADPSPPAPPPAIPGVLPPASLPPIQSVTAVPGGITTNNRFVATPQAPGPAALGQPPLAVAAPVSESLHDYFKAKNIKLVAQKPHGFKALDITLPVPTRWTQVPDPNVPDAFAVIADRLGNSLYTSNAQLVVYNLVGNFDPKEAITHGFVDTQQLSAWQTTNASKADFDGFPSSIIEGTYRENGMTLNTSRRHVIASSGPDKYLVSLSVTTALSQAVADAPATNAIVNGFRVSSPTVSAPVPPQLGTR

SEQ ID NO: 7 - protein, 467 aa, Mycobacterium leprae
MRNPVWLRFSMGRALLVTALVPPCIILFFHTQYWWAGIALVVLVVILTLVEFSGRWLSGWLMALYSFFRRSSKPLDTPSEPVIGATVKPADQVIMRWQDGFLVSVVELIPRPFTPTVIVDGEAQTDDLLETQLLEHLLSVHCPDLEAVVVSAGYRVGHVASLDVVNLYQQVIGADPAPAHRRTWIMLRADPVRTRKSAQRRDAGVAGLARYLIASTTRIADQLASHGVDAVCGHSFESVDHATDVGFMQEKWSMMRGQNAYSVAYTAPAGPDAWWSARADHTITRVWVAPGKTPQATVVLTTLGKPKTPCGFYRLHGAQQPALLGRSFVAYQHCQMPIGSAGVLVGETVNRCSVYMPFDDVDVSVSLGDVQTFTQFVVRAAAAGGIVTLGQQFEKFARMIGGQIGSVAKVAWPNATTYLDPYPGSERVILKHDIIGTPRHRKLPIRRISPPEEGHYQMVLPKSSYEL

SEQ ID NO: 8 - protein, 113 aa, Mycobacterium leprae
MDLDPTQAQTMALLGQFQSALDEQCNRMTDGVFKASDQEKTVEVTINGYQWLTGIRIESGALREFGHAVVADRINEALQNAQGVATAYNEVSGEQLAARLSALSCSIGEPPPT

SEQ ID NO: 9 - protein, 512 aa, Mycobacterium leprae
LSAPAVTAGPATAGITPARPSATRVTILTGKRMTDLVLPSTVSIEAYIDETVAVLSDLLEDAPADVLAGFDFSAQGVWTFARPGSPPMKLDQSLDDAGVVDGSLLTLVSTSRTERYRPLVEDVIDAIAVLNESPEFNRKAVDRFIGVAIPVLSLPITAVAVWAWWVTGRSPFWSLAIGILSIVALTGSIVAEKFYKNLDLSESLLLTSYPLIASAAALVTPLPNGVDSLGPPQVAAAAAAVLFLTLLTRGGARRHSGYASFTAITTIAIVVIAIAYGFGYQHWVPTGAVAFGLFIVTNAAKLTVAVARIALPPIPVPGETVDNEELLDPVVTPHEATHEETPTWQAIIASVPDSAVRLTERSSLAKRLLIGYVISGTLILCSGAIAVIVRGHFFAHSLVVAFLLTVVCTFRSRLYAERWCAWALLAAAVVIPTGLTVKLCIWYTQIAWLLLTSYLVAAIIALMVFGATVRVRRVSPVTKRIMELIDGAVVASIIPLLLWIAGVYDMVRNLSF

SEQ ID NO: 10 - protein, 586 aa, Mycobacterium leprae
MAADYDKLFRLDDGAYASPDQAAEQLFDDAPLYPPPIIPTCTTTPNGEVASPMPDWSEQLPPNPPAASKSPLPPMPIGSSVQPPPASSESPRAPMPVSAPPRSPAASLMPISEPPQWPPAEAPEHQFAKAEPPSVPIPINEPSPAKPATPMPMTPIDGSQRTPVTSPEPSLAEFEAQPPATPKPSLLPRPMSSPPEAPRPSANQHSRHARRGHHHRDETQQANPASATEPMIAPRARTAELRQAPHAAAEPAPTQHLTRPDGLVSHRTALHDSTATSAIGVQTGRSTGAKKPSKVVAKRGWRHWVHTVTRINLGLSPDERYELDLRTRVRRPPRGSYQIGILGLKGGAGKTTVTVTLGSMFARVRNDRILVVDADTSCGNLADRAGRFSEANIADLLADKDVKSYNDIRTHTSVNAVNLEVLPAAEYSTAQHALSGEDWNFAAATVSKYYNVMLADCGVGLFDPVTRGVLSTASGVVIVTSTSVDAARQAAIALDWLRHNGYQDLLSRACVVINHVMPKEPNIASKDLVQQFEQQIQPGRVVVLPWDKHIAAGTEIRLDRLDPLYRRRILELAAALSDDFERAGRH

SEQ ID NO: 11 - protein, 95 aa, Mycobacterium leprae
MIQAWHFPALQGAVNELQGSQSRIDALLEQCQESLTKLQSSWHGSGNESYSSVQRRFNQNTEGINHALGDLVQAINHSAETMQQTEAGVMSMFTG

SEQ ID NO: 12 - protein, 100 aa, Mycobacterium leprae
MAEMITEAAILTQQAAQFDQIASGLSQERNFVDSIGQSFQNTWEGQAASAALGALGRFDEAMQDQIRQLESIVDKLNRSGGNYTKTDDEANQLLSSKMNF

SEQ ID NO: 13 - protein, 302 aa, Mycobacterium leprae
MTWPMLWPASVPSECPPNYWHTPAPSAKCEPEQAAVAPIAAAKPMITWLQSAAEQTTTQAEAHRQAMASTPGMAVITENHITQAILATINFFGINMAPIAFTEAGDFICMRTQTALAMNSYQAETLLNTAFQKLEPMAAILNPSSYSPPSALTSQVNQFTQMISGFSAALPSTQVLQQTVGQVAELARPMQQVKSLFTSIDSTGVYTSAQRGDTESAHRIGLFGASTLSSHPLVGITGTTTDTRLLCAESLPSASGSLAWTPLMTQFQLIDKSIAPEPRQRVMLPPWAAGSPGHNAQDGGTT

SEQ ID NO: 14 - protein, 481 aa, Mycobacterium leprae
MGLRLTTKVQVSGWRFLLRRVEHAIVRRDTRMFDDPLQFYSRSIALGIVVAVALLIGAVLLAYFKPQGKLGASTLLTDRATNQLYVLLSGHLYPVYNLTSARLALGKPANPAAVKSSELTKLPIGQTIGIPGAPYATPVSGDSSSTWTLCDTVAKIESESPAVQTSVIARSLQIDPAINPLQPNEALLASYRDKTWLVNSKGRHSIDLADRALTSAIGISVNVKPTPLSEGLFNALPDVGRWELPTIPDTGAPNSLGLSPDLVIGSVFQIQMEKSPQYYVVLSDGIAQVNATTADALRATQSHGLVAPPSLVPNVVVQIPERVYDSPLPDEPLKMVARDDYPTLCWAWERKASDQAPKRTMLIGQHLPLQPSAMSTGIKQIRGTATVYIDGGRYVALQSPDPRYSESLYYVDPEGVRYGLANSEAVKALGLASPQTAPWVIVRLLVEGPVLSRDAALLEHDTLIADPSPRKVPAGYSGVRP

SEQ ID NO: 15 - protein, 169 aa, Mycobacterium leprae
VNLLGNDDDNHLASLDFYSANRYYEESLFFDELDGYAPTTPVGIEANDLDVFQSLTEPEEELEVELLAVTNPAKSVSALMNGRVHQVELTDQVTRIGEKKPATEAFVLASLARQKARTSQGTCILDSLQGGGENTTARCELVGLTLNLPTSEQAAAEAEMFSNNILRQK

SEQ ID NO: 16 - protein, 238 aa, Mycobacterium leprae
MGLFHKRRSRAMRRAEARAIKARAKLEARLAAKNEARRLNSAQRATNKALKAQLKAKRNSDRVALKVAETELKAAKEGKLLSPTRIRRVLTVSRLLAPIVVPLIYRAAIATRALIDQRRADQLGIPLAQIGQFSGPSARLSARIARSEQSVLLVQEKKPKDAETKQFVSTITERLIDLSAAVAAVENMPATRRRAVHSTISSQLDGIEADLMARLGVDLTTSMADNRSVADSTRKAAT

SEQ ID NO: 17 - protein, 132 aa, Mycobacterium leprae
MSTTFAARLNRLFDTVYPPGRGPHTSAEVIAALKAEGITMSAPYLSQLRSGNRTNPSSATISALANFFRIKPAYFTNDEYYEKLDQELAWLATMRDEGVRRIAMRTIGLSAQAQQDIVDRVDELRRAEHLDV

SEQ ID NO: 18 - protein, 177 aa, Mycobacterium leprae
METGSGLPIGVVPFHARGALKGFVISGRWPDSTKEWAQLLMVAVRIASLPGLLSTTTVFGAREELPDEPEPGTVGLVLAEGTVFGESAIQPGYFADHQPPALLMLHPPSETMPSLPECTGAASGCVLLPGLPYLGLEHRAAWVEAEADGTITSMVSRVGVDPISHPDTAILAMLLAA

SEQ ID NO: 19 - protein, 344 aa, Mycobacterium leprae
VIQVCSQCGTRWNVRERRREWCLRCRGALIAPQAEMPTAVKQWSSHVGLPAGIVPEALGWQRTPPGFRWIAVRPGAAPPNRRRQRHHVPTPRYAVMPRWGLADRVDQDSTWIQAPLKPGPSSAKVRTTLFVAVLVFTLAALVYVVRYVLLVINRNTLLNFGVAAIADWLGVIASLAAIAATLACVMALSRWLIARRAAAYAHHAVPEQRSSWELRAGCLLPLVNLLWAPVYVIELALMENHYTQLQKPIFMWWIVWVFSYVISVVAVVTSWAKDAQGIANNTVAMVFAYLFAAAAVAAVARVFEGFECKSIKRPVHRWVVVHLGGSVVHPSPGSVELEGQEPAA

SEQ ID NO: 20 - protein, 450 aa, Mycobacterium leprae
MLDAPEEEPALADDLTGEDEQPPVEFQWPSTLQARATRRGLLLTALGGLLIGGLVTAIPTVGTGSGLLATYIDSNPVPSTGAKSNVAFNRATNGDCLMWPDSTPHTAVIVNCADDHRFEVAESIDMRTFPGSEYGPNAAPPSPARIQQISEEQCETAVRRYLGTKFDPNSKYTISMLWSGDRAWRQSGERRMLCGLQLPGVNNQQVAFKGKVANIDQSKVWPAGTCLSIDLTTNQPIDIPVDCVAPHAMEVTGTVNLADKFPNALPAASEQDTFIKDACTRLTDIYLAAIELRTTTLTLIYPTLSLSSWAAGSRKVACSIGATMGNGGWATLVNSAKGPLLINNQPPTPPPDIPEERLGMPPIPLHHLQVPNSQSNVPVNPIPPGNQQHRKQQPIVTVPQSPASTAPAASVSPAKHLPKARHTRQMSKRRGRPISPHPWAGRASPGGLAE

SEQ ID NO: 21 - protein, 236 aa, Mycobacterium leprae
VPNRRRCKLSTAISTVATLAIASPCAYFLVYEPTASAKPAAKHYEFKQAASIADLPGEVLDAISQGLSQFGINLPPVPSLTGTDDPGNGLRTPGLTSPDLTNQELGTPVLTAPGTGLTPPVTGSPICTAPDLNLGGTCPSEVPITTPISLDPGTDGTYPILGDPSTLGGTSPISTSSGELVNDLLKVANQLGASQVMDLIKGVVMPAVMQGVQNGNVAGDLSGSVTPAAISLIPVT

SEQ ID NO: 22 - protein, 643 aa, Mycobacterium leprae
MTAVSLLARVILPRPGDPLDVRKLYLVESITNARRAHALSPTTLQIGAESEVSFATYFNAFPASYWRRWTICKSVVLRVEVTGAGRVDVYRTKANGARIFVEGREFAGVEDDASKAQVVELEVGLQPFEDGGWIWFDITAETRVTLCSGGWYATSPAPGRANIAVGIPTFNRPADCTNALAELTADPLVDEVIGAVIVPDQGVRKVRDHPDFPEAAARLGDRLSIHDQPNLGGSGGYSRVMYEALKNTDCQQILFMDDDIRIEPDSILRVLAMHRFAKSPMLVGGQMLSLQEPSHLHIMGEVVNRSNFIWTAAPHAEYDHDFVEYPLNDKEDKSKLLHRRIDVDYNGWWTCMIPRQVAEELGQPLPLFIKWDDADYGLRAAEHGYPTVTLPGAAIWHMAWSDKDDAIDWQAYFHLRNRLVVAAMHWDGDVTGLVRSHLKATLKHLACLEYSTVAIQNKAIDDFLAGPDHIFSILESALPEVHRMRKEYPDAVVLPAATELPPPVHKNKVMKPPENPLSIVYRLLRGIFHNLTAADPECHKRPEFNIPTQDARWFRLCTVDGVTVTTADGCGVVYRQRDRAKMFLLLFSSLHRQLQLARRFDELRKIYRDALPVLSSKQKWEMALLPLPDSPTRFPAEQEPEHA

SEQ ID NO: 23 - protein, 192 aa, Mycobacterium leprae
MPEDKAPTGELAAIAAVQSVLVDRPGVLPTARGMSHFGEHSIGWLAISLLGAILVPCRRRYWLVAGAGVFAAHVAAVLIKRMVRRIRPNHPAVTVNVGTPSPLSFPSAHATSTAAAAILIGRASRLPKGIVAAVLVAPMALSRIVLGVHYPSDVAFGVVLGAAVAGTTARFDSRLSRRWTVQHGLSSGSAVK

SEQ ID NO: 24 - protein, 649 aa, Mycobacterium leprae
MRRRMVSRQVGWPLFPYHIVVRVSLWASVLLVAALFGWGAWQRRWIADDGLIVLRTVRNLLAGNGPVFNQGERVEANTSTVWTYLLYAGSWVGGPMRFEYVALAAALVLSVLGMVLLMLGTGRLYAPSLQGRQAIMLPAGALVYVALPPARDFATSGLESGLVLTYLGLLWWMMVCWAQPLRNRSQSRRFIGALAFVAGCSVLVRPELALMGGSALIMLMIAARTCWLRALIVVAGGSLPVAYQLFRMGYYGLLVPGTALAKDAAGDKWSQGIIYLSNFNQPYVLWVPLVLLVLLGLLLMLIHRWPSFMHPLETPDSGRVARAVQSPPAVVVFVVFSGLLQAFYWIRQGGDFMHGRVLLAPLFCLLAPVVVIPVVISEGADFSRQTGNWLAGVTSLLWLGVAGWSLWAANSPGMGDDATNVSYSGIVDERRFYAQATGHAHPLTAADYLGYPRMAAVLVALNNTPDGALLLPSGNYIKWDLVPMIQLSPSSPGSPPDSLVSQKPQHTVFFTNLGMLGMNVGLDVRVIDQIGLANPLAQHTERLQHGRIGHDKNLFPDWVIADGPWVKWYPGIPGYLDQAWIAQAVAALQCSGTQAVLSSVRAPMALHRFISNLLNSFEFTRYRFDRVPLYELVRCGLPVPDVLPATPPE

SEQ ID NO: 25 - protein, 336 aa, Mycobacterium leprae
MVEKVPRKRHRVLAWTAALSMAAVVALAIVAVVILLRSAESPRSSLPPGVLPIPSTAPHPRKPRPAFQDVSCPDVQLLVVPGTWESSLQDNPLDPVQFPDALLRNSTMTIGQQFPTSRVQTYTIPYTAQFHNPLSGDKQMTYNDSRAEGTRAMVQEMINVNNKCPLTSYVLVGFSQGAVIAGDITSDIGNGHGPVDDDLVLGVTLIADGRRQQGVGNDIGPNPPGEGAEVTLHEVPVLSGLGMTMTGARPGGFGVLHSRTNEICAPGDLICAAPAEAFSVANLPATLNTLASGAGQPIHAMYATAQFWDLDGAPATVWTLNWVHRLIEGAPHPKHG

SEQ ID NO: 26 - protein, 632 aa, Mycobacterium leprae
MRNALASFGQIVLAAVVASGVAAVSLIAIARVHWPAFPSSNQLHALTTVGQVGCLTGLLAVGGVWQAGRFRRLAQLGGLVFVSAFTVVTLGMPLGATKLYLFGISVDQQFRTEYLTRLTDSAALQDMTYLGLPPFYPPGWFWIGGRVAALTGTPAWEIFKPWAITSITIAVAITLVLWWQMIRFEYALLVTIATAAVTLVYSSPEPYAAMITVLLPPALVLTWSGLRAAEREADRTLGNKRGWATVVGAGIFLGFAATWYTLLLAYTAFTVVLMTLLLATALCRRAGFRATFDPLRRLAGIVVIAAAIGAITWLPFLARAAHDPVSDTGSAQHYLPADGAELAFPMLQFSLLGMICMLGTLWLIVRTSSSVRASALMISVLAVYLWSLLSILTTLARTTLLSFRLQPTLTVLLVTAGVFGFIETAQSLAKHNRAVLSVASAIGLAGAIAFSQDIPNVLRPDLTIAYTDTDGHGQRGDRRPPGSEKYYWAIDEAVLHITGKPRDQTVVLTADYSFLAYYPYWGFQGLTSHYANPLAQFDLRAAQIQQWSRLTTASELIHALDTLPWPPPTVFVMRHGAGNTYTLRLAKNVYPNQPNVRRYTVDLPAALFADQRFAVQDIGPFVLAIRKPMGNA

SEQ ID NO: 27 - protein, 174 aa, Mycobacterium leprae
LNNDNDDSIEIIGGVDPRTMATRGEDESRDSDEPSLTDLVEQPAKVMRIGTMIKQLLEEVRAAPLDEASRNQLREIHATSIRELEDGLAPELREELDRLTLPFNESTAPSNAELRIAQAQLVGWLEGLFHGIQTALFAQQMAARAQLEQMRHSALPPGMGKPGQAGGQGTGQYL

SEQ ID NO: 28 - protein, 654 aa, Mycobacterium leprae
VGLCCGTLIALFLLIVPETIVARFAALTWPIAIAVSPALTYGVIALVIIPFGAVGIPWNSWTALAALVAVSMLMIAFRLLLVRYRDTAAETRGISGWPAVTVAVGVLLGALLIGWAAYRGLLHWQSIPSTWDAVWHANTVRFILDTGQASPTHMGELRNVETHSVLYYPSVLHALAGVYCQLTGAAPTTGYTVSSLAVAVWLFPVSAATLTWHLLRPVTTQKRAAGASATAAALSAAFTSVPYVEFGVAAMPNLAAYGVAVPTMVLITSTLRHRDRIPVAILALVGTFSVHLTGGIVVSLFLLGWWLMNALLHPVRSRAADARTLAAVVMPTALILAPQFIAVLNQADIIAGHSFPSFKSVKQGVIDALLLHTRHLNDFPIQYGLVVLAAIGMAILLYQKIWWPSIAWLVLTVATVYSAAPFRGPIGSAIESFSQFFYNDPRRLSAVVTMLLTPMAGIALFAGVLLLVVGARRVTARFTALPRPVWTTATVVLLVAATVLTAWHYLFRHLVLFGDKYDSVMVNQKDLDAMSYLATLPGAHNTIIGNSNTDGSSWMYAVADLHPLWTHYDFPQQTGPGYFRYAFWAYARTGNPWVVEAVRVFNIRYILTTSPTVQGFAIPDGLVSLEESKSWTKIYDNGAARIFEWSGNATATRA

SEQ ID NO: 29 - protein, 146 aa, Mycobacterium leprae
MPVLSKTVEIDTDTATIMAIVTDFESYPQWHEWIKGVWVLAHYDDGRPSQLRIDINFQGMQGTYIQAVYYPGVNQIQTVMQQGDLYSKQEQLFSVTQAEGGSVLTVDLDVELTMPVPAPMVKMLLNTALDRLAEKLKLYAEHLAPS

SEQ ID NO: 30 - protein, 210 aa, Mycobacterium leprae
MTNRTLSREEIRKLDRDLRILVATNGTLTRVLNVVANEEIVVDIINQQLLDVAPKIPELENLKIGRILQRDILLKGQKSGILFVAAESLIVIDLLPTAITTYLTKTHHPIGEIMAASRIETYKEDAQVWIGDLPCWLADYGYWDLPKRAVGRRYRIIAGGQPVIITTEYFLRSVFQDTPREELDRCQYSNDIDTRSGDRFVLHGRVFKNL

SEQ ID NO: 31 - protein, 105 aa, Mycobacterium leprae
MRPEPPHHENAELTEMNTEVVEAPLLTDIEELREEIDRLDAQILATVKRRAEVSQAIGKVRMASGGTRLVHSREMKVIERYSELGPDGKDLAILLLRLGRGRLGH

SEQ ID NO: 32 - protein, 314 aa, Mycobacterium leprae
LHCSSGAVTALEITGGVMTYLPGSPGYPLVQPAGSYPGATPSFVKSDVGESQLYHYLTIAVVVLGLAVYLGNFGPTFTSSSDIGPGSGGFAGDAGTAVVVALLAALLAGLDLLPKAKSSAGVVGAIAVLGALLAISEMINMPAGFSIGWAMWFILVCSVLQAIAAVAALLLEAGIITAPAPRLSYDPYLQYGQYGAQSYYGQPNRQLQVGLNAHSPQQSPAGYGAQYGAYTSSPTQIQAGMPATGGFSAQHSAQQGPSTPPTGFPSFSPPPSVGAAAGSQAGSAPVSYSNPTDSKQGFGQGRESTSSSSGSAPV

SEQ ID NO: 33 - protein, 430 aa, Mycobacterium leprae
VGDNRAAGVRQARDLVKVAFGPAVVALAIIAAITLLQLLIANSDMTGALGAIASMWLGVHQVPIAIGGRELSIMPLLPVLLMVWATAHSTSQATSAYSSWLVIRWVVASALGGPLLIAAISLAVIHDASSVLTELQTPKALRAFTGVLVVHAIGAAIGVNSRVGRRVLTASRLPDWVGDSVHAATAGVLALLGLSGLVTAGSLVVHWATMQEFYGITDSIFGQFSLTVLSVLYAPNVIVGTSAVAVGSSAHLGFATFSSFTVFGGDIPALPVLAAAPTPPLAPVWVALLIVGAASGVAVGQQCTRHPLPLLAALAKLLVAAATGALMMALLGYAGSGRLGNFGDIDVDQGALVVGVFFWFAVVGWVTVVVACGIKRFPRHLKPPPALSSEEHADASSKDHEAYFGVDLNVPFDLSGEDEIPKAEPGEAAD

SEQ ID NO: 34 - protein, 200 aa, Mycobacterium leprae
MSNSAQRDAKGARDEPLRAADTDRIQIAQLLAYAAEQGRLELKDYEDRLAKAYAATTYQELEQLRDDLPGSQVSARRGGNPNPAPSTLLLALMSGFERRGRWNVPRKLTTFSLWGSGVLDLRYADFTSTEVELHAYSVMGVQTILLPPEVNVEISGHGVMGSFDRQVRGQGTPGAPTVKIRGFSLWGGVGIKRKARRPRR

SEQ ID NO: 35 - protein, 342 aa, Mycobacterium leprae
MPSIPQSLLWISLVVLWLFVLVPMLISKRDVVRRISDVALATRVLNGVAGARLLKRGGPATGHRSDHNWELDEDWRQNPVDGEFADADQDIGEEQDQNVDDTQRTRPVVMEVAVAELTGTDYLDVDVVEDSVALPIEDSADVTESVLLAVGEGGSPGEEAEAEQRQSDRYGYVDASSGLGLEQKDDKSPVPVAPTVSRQRRYDTKTATAVSARKYAFRKRVLMVMAIILVGSAAAAFEVDSNAWWICGSSTTVTVLYLAYLRRQTRIEEKVRSRRMHRIARARVDVENAHDREFDVVPSRLRRPGAVVLEIDDEDPIFEHLDYEMPIRTFGWPRDLPRAVGQ

SEQ ID NO: 36 - protein, 353 aa, Mycobacterium leprae
VAGSWQCGHCESCASPLGPRDIAVVELIADRAEEFAAMDIFRGLPAEDLMSVAVSVEPVLAAAGEVLMQQGEQAVSFLLISSGNVEVRRVDDDGAVIVGQASHGMIIGEIALLRDGRRTATVITTEPLTGWVGDIDAFAQMVQIPSITRRLLLTVRQRLAAFITPIPVQLRDGTHLMLRPVLPGDTERSLRGHVRFSRETLYLRFMSARAPSDELMHYLSEVDYVDHFVWVVTDGGDPVADARFVRDESDPTLAEIAFTVADAYQGRGVGNFLISALSIAAHVNGVNRFSARMLTDNGPMRAIMDHHGAVWRRYDVGVITTVIDVPRQRDLIIGRAMADQIAGVVRQVIGAVG

SEQ ID NO: 37 - protein, 205 aa, Mycobacterium leprae
MCDMLVDVGIAFQGSLFEYHERRQLGDGAFIELRSGWLTDGVELLDTLLSEVPWRIERRRMYDKVVNVPRLVSFHDLTTDDPPHPLLTRLRRRLNDIYAGELGEPFTSVGLCCYRDGSDSIAWHGDTIGRNSSEDTMVAIISLGATRVFALRKRGGGPSLRLPLTHGDLLVMGGSCQRTWEHSVPKTSASTGPRVSIQFRPRNVH

SEQ ID NO: 38 - protein, 200 aa, Mycobacterium leprae
VSQLSFFTAESLLPAIADLAGVLAASGQIVVVSASGQSPAPAARLSVVVDQLWRASALAEMISEAGLVPEISRTEEDTPLVRTAVDPLLCPIAAEWTRGAVKTVPPRWLPGPRELRAWILAAGVPEAANRYLLGLDPHAPDTHSPLASALMRVGIAPTLIGTRSGRPALRISGRRRLSRLLENVGEPPDWAEALALWPRV

SEQ ID NO: 39 - protein, 113 aa, Mycobacterium leprae
MNWIQVLLIGSIIVLLIYLLRSRRNVRSRAWVKVGYIAFVLGGVYAVLRPNDTTVVAHWFGVCRGTDLMLYALIMAFSFTTLSIYIRFKDLELRYACLARVVALEGARAPEPF

SEQ ID NO: 40 - protein, 158 aa, Mycobacterium leprae
MGPTRKRDLTAAMIGAAVVGYLLVLVLYRWFPPITVWTGLSLLAVAIPEALWARYVRTKISDGEIGDGPGWLHPLAVAHSLMVAKASAWVGALVLGWWVGVLVYFLPRWPWLRVADKDTSGTVVAALSALALLVAALWLQHCCKSPQDPTEHGEGAEN

SEQ ID NO: 41 - protein, 309 aa, Mycobacterium leprae
MVQFDGLRSARLNIAILSTGRVGVALERADQVVVACSAVSHASRQWVQFRLPETSVASPPEVASSAELLLLAVPDCEFAGLMSGVAVTSVPRPGTIVAHTSWANGVGILAQLGKDGCIPLAIHPAMMFSGSDEDLSQCQLRDTYFGITKTDDVGYAIAQSLVLEMGGEPFCVVEYARILYHSVSPHVGNHIVTVLADALEVRRSALRGSELLGLGVPPACRGEVVDDQLDVIVERIVGSLARAACENTLQRGQAGLTKLVARGDLDALAGHLVALMRIGPELAQAYRVNALRKTQRAHAPYDVVEALAP

SEQ ID NO: 42 - protein, 227 aa, Mycobacterium leprae
MSEAKRLDPKRRSPASRPGKAGDSVRGRRSTKPVAKLSVKPSRTTPASSHSGRNSTRMLTQHVVEPIRQSIIESRERRSDQQLGFTARRAAVLAAVVCVLTLTIAGPVRTYFAQHAEIEQLAATEATLRRQIADLEQQKGKLADSAYIAARARERLGFVMPGDVPFQVQLPSTAAVSSQPGGRAAKPANNDPWYTSLWHNIADAPHLPPGAGTPPFSLTPLSTTSGG

SEQ ID NO: 43 - protein, 167 aa, Mycobacterium leprae
VVDRADLEAVARHLGREPRGVLEIAYRCPSGEPGVVKTAPKLDDGTPFPTLYYLTHPVLIAAASRLESTGLMREMTERLGQDPELAAGYRRAHESYLTERDAIESLGTTFSAGGMPDRVKCLHVLIAHSLAKGPGLNSLGDEVLALLAADPKTAATLVAGQWKECDR

SEQ ID NO: 44 - protein, 123 aa, Mycobacterium leprae
MRLGQALAWLATDIVAVSVFCAVGRCSHAEGLTVADLAVTLWPFLTGTAIGWLASRGWQRPTAVVPTGVVVWLCTVVVGVALRKASSAGVVANFMVVAASTTAALFLGWRAVVELILRRRSTR

SEQ ID NO: 45 - protein, 218 aa, Mycobacterium leprae
VTYYSSLRPEDLPPERPKHEHYSGFPEYELANPGVGFRRFVATMRRLQDLAVSADPSDEVWYAAADRAVALVELLGPFATDEGKAPAGRVPDMPGMGSLLLPPWTLTRSGPDSVEMTGYFTRFHVGFNHAVHGGVLPLVFDHLFGMISYTAGRSISRTAFLHVDYRKITPIDEPLVMRGRVTRTEGRKAFVSAELVDGDEMLLAEGNGMMVRLLAGQP

SEQ ID NO: 46 - protein, 229 aa, Mycobacterium leprae
LNTSDSAPGVAVLLFGDDRTRQRWNTLTALSTYRAGGPDDIDSIDATIGPYRRLVVVGGDGDLAAVLGRLLRADRLDIEVAYVPHQRTAATRVYRLPTGRRAARRARRGYATRVPLIRDETGSVIVGRADWLPVVDRQPLHGEAIVDDIPLFDGDVAGVRIAPTLAMPGLRARLHTSRTGIGIWSRWLTGRAVQLGSTGVAVVRDGVPTRRRERRSTFYRNVEGWMLVR

SEQ ID NO: 47 - protein, 137 aa, Mycobacterium leprae
MTSMGDLLGPDPILLPDDSAAEVELRANKDPGTVAAAHPSASVAWAALAEGALADDKATTAYAYARTGYHRGLDQLRCNGWKGFGPVPYSHEPNRGFLRCVAALARAANAIGETDEYRRCLNLLDDCDPAARNELGL

SEQ ID NO: 48 - protein, 292 aa, Mycobacterium leprae
MPNASEPERGITLNRPGLAPRTLDKNVVSNLPEAKDNPAMTHGEEIAAGYPLAHSDSETEAMVLTKTEPDQDPGADRQHHERRFTAPGFDARATAIMATAPDPATEAIHPPLSSSDPPGHLGISPKAAVPQSIPPVLGTKLRSARHFHWGWVVALLMMVLALAAIAILGTVLLTRGKHVKASPAEQVRHAIQSFDVAVQTGNLTALRSITCGTTRDGYVEYDESSWDETYHRVSAAKQYPVIASIDQVVVNGQHAEANITTFMAYDPQVRSTRSLDLQFCDDQWKICQSPSG

SEQ ID NO: 49 - protein, 74 aa, Mycobacterium leprae
MIVVVNERPVEVNEQTTVAALLESLGFPASGIAVAVEFSVLPRSYWATKISELPAVTGRSEPIRLEVVTAVQGG

SEQ ID NO: 50 - protein, 289 aa, Mycobacterium leprae
VRYRRQVAHTRKLLAALSRRGPHRVLRGDLSFAGLPGVVYTPAGGLNLPGVAFGHDWLTGTARYAGLLEHLASWGIVTGAPDTQRGLTPSVLNLAFDLGSALDIVAGVRLGPGNISVHPAKLGLVGHGFGGSAAVLAAAGLPGLAGLPAKSAVAIFPTVTSPAPEQPAATCKVPGLILTAPGDPKTLNSNALSLYRAWDDATLRIVSKAKAGGLVEGWRMTKVVGLAGPHRATQKAVRSLLTGYLLYALGGDKEYRDFADPDMHLPHTVPVDPEAPLVTPEQKIVTLLK

SEQ ID NO: 51 - protein, 281 aa, Mycobacterium leprae
VTSVSIVVEIGHTSAAEPMLAAAAFGNQPGRWPLPTATTPHQLWLRAVAAGGQGHYSSAYRDLAVLRRSVPAGRLASLAHSTHGSFLRQLGWHSLARGWDGRALVLAGTDSEARADALIGLAADALGVGRLAAAATLLRRVGSALAPAQLPAQVADRLAVRRRWVAAELAMAVGDGATAVRHAREAVELAQVGRVVSVRHQVKSDVVLAAALCSAATERARVVAEAALAATGRLGLIPLRWALACLLIDIGSVTFSEPELSELRDVCADQVRRAGGTWRTA

SEQ ID NO: 52 - protein, 137 aa, Mycobacterium leprae
VRDHLPPGLPPDPFADDPCDPSAALDAVEPGQPLDQQERIAVEADLADLAVYEALLAHKGIRGLVVCCDECQQDHYHDWDMLRANLLQLLIDGTVRPHEPAYDPEPDSYVTWDYCRGYADASLNQATSDADGYRRRH

SEQ ID NO: 53 - protein, 394 aa, Mycobacterium leprae
MSGAFIIDPTLKAIEAWHALLGIGVPNDGGVLYSSLSFFEKALEHLAAAFPGDGWLGSAADKYAGQNRKRVDIFQELAELDKELIELIHNQANSVQTTRGILDGAKKALLFVRPVAIDLNYIPLVGSVMSASIQAQACAAAMAAVSGGLAYLLVQTAIHTAKFVALLARLAHLLASAVADVVSDGVAIIKGIVDHLWHFIAGALTGLKDIVEKIIHWFFGLFSHWWSRLHSFFGGIPGLSGATSGLSQVTGLFGVPGLAGSSGLLSGESLLSTENLPSLAGVGAGLGLGSLPQLAQLHAASTRQGTRSQAGVSAELSTEQFGGQQEPVSAQGSQGMGGSQGMGGMTPASTKSKKDERKKKKYSEGAAAGTDDAERAPIEVQSGGGKRALAQHVV

SEQ ID NO: 54 - protein, 106 aa, Mycobacterium leprae
MRSMIDNLTVQSEHLNSLASQHENEAACASSGVSAAAGLANAVSTSHGSYCAQFNDTLKMYEDAHRTLGESLHTGGIDLARVLRVAAAMYCDADEICGSDIKSAFG

SEQ ID NO: 55 - protein, 216 aa, Mycobacterium leprae
MGSRRRINRRLLPMSTFPAWQEFRRDVVVVFPGNDFDRDDCDTVDPWGVGGAAHWTIDPIVGFASSSAPQDRGTDVDNTRGQAEEDEKQKEPEVAIFTVTNPPRTVSVSVLMDGRIDHVELSKRVTWMSESQVASEILVLADLARQKAQSAQYTFILDKLSQLADGDEHRVALLRESVGNTWNLPSPEQAAEAEAEVFATRYSDYCPAQDTENDQW

SEQ ID NO: 56 - protein, 100 aa, Mycobacterium leprae
MSFFLRVEVGGLMMAAGRLERITSESMACNAKLTPVTTKVVPPAADQVSKLVSQVFSSYGKQYEGYAAQGVDQSRLFVQSLKDAAGDYMDSDHMYLNTED

SEQ ID NO: 57 - protein, 408 aa, Mycobacterium leprae
MFDFMVYSPEVNAFLMSRGPGSTPLWGAAEAWISLAEQLMEAAQEVSDTIVVAVPASFAGETSDMLASRVSTFVAWLDGNAENAGLIARVLHAVAYAFEEARAGMVPLLTVLGNIIHTMALKAINWFGQVSTTVAALEADYDLMWVQNSTAMTTYRDTVLRETGKMENFEPAPQLVSRYCMDRRDSVNSFHSSSSSDSLYESIDNLYDSVAQSEEHGSDSMSQSYNTCGSVAQSELCDSPFGTPSQSSQSNDLSATSLTQQLGGLDSIISSASASLLTTNSISSSTASSIMPIVASQVTETLGRSQVAVEKMIQSISSTAVSVDVAASKVVAGVGQAVSVGALRVPENWATASQPVMATAHSVPAGCSAITTAVSGPLEGVTQPAEEVLTASVAGGSGTGGPAFNEAV

SEQ ID NO: 58 - protein, 210 aa, Mycobacterium leprae
LSVDEVLTTTRSVRKRLDFDKPVPRDVLMECLQLALQAPTGSNSQGWHWVFVEDAEKRKAIGDIYLVNARCYLSQPAPEYPEGDTRGERMRLVRDSATYLAEHMHEVPVLLIPCLLGRAEESPLGAVSYWASLFPAVWSFCLALRSRGLGTCWTSLHLLGDGEQRAAEVLGIPSDKYSQGGLFPIAYTKGTDFRPANRLPAENVTHWDIW

SEQ ID NO: 59 - protein, 75 aa, Mycobacterium leprae
VADRHPDTIKLEIDVAREQFAATVDSLAERANPRRLAGDLKARVVEFGRRPAVIAALVSCAVLTVIVVVRKVKNR

SEQ ID NO: 60 - protein, 259 aa, Mycobacterium leprae
MNNPRRSEWLGPSLAGSGPIEPQVHQYPPLTDPAYAEQAPYAPAYGASLPPWTPKKPPQQLPRYWQQDQPPPTDIPPEGLTLPPPHEPKSPHWFLWVVAGASVVLVVGLVMALIIANGAIKTQTAVPPLPAITESSSATPTPTTKTSPTPTAGPAPSTTGSGTLTQTIGPSAMLDVVYSITGQGRAISVTYMDTGDVIQTEFNVVLPWSKQVSLSKSAVHPASVTIVNIGHDVTCSVTVAGVQIRQHTGVGLTICDAPR

SEQ ID NO: 61 - protein, 349 aa, Mycobacterium leprae
MLTLLVLLVALATLAGGWGYQTANRLNRLHVRYDLSWQALDGALARRAVVARAVAIDAYSGTSPGRRLAALADAAECAPRHTRENAENELSAALAMVDPASLPTALIAELADAEARVLLARRFHNDAVRDTLALGEQRLVRTLRLRGTASVPTYFEIVERPHALTHGDHGVPNQRTSARVVLLDETGAVLLLCGSDPAITNGHAPRWWITVGGEVRPGERLAAAAARELAEETGLRVIPTHMVGPIWRRDAIFEFNGSVIDSEEFYLVYRTRRFEPSTVGWTELEHLCLHGSRWCDANDIAELVASGEQVYPRQLGELLPVANQLADASTGTARGTAAARNTYVLLSIC

SEQ ID NO: 62 - protein, 114 aa, Mycobacterium leprae
MESLVLLLLFLLIMGGFMFFASRRQRRSMQATIDLYNSLQPGDRVNTTSGLQATIIVVGDDTVDLEIAPGVVTTWMKLAIRDRILPDDAYMDEHEAEPGDFVYCDELEESDGSS

SEQ ID NO: 63 - protein, 202 aa, Mycobacterium leprae
MNNWMLRGLVFAALMIVVRLMQGTMINVWQAQSVLISVVLLAVFIIAVVVWAARDGRADAIANPDPDRRRDLAMTWLLTGILVGVLSDAVAWVISLLYNGIYTGGLVSELTTFSAFTALIVFLTGIIGVACGRWRVDRRSPPVPEHSRSGQNRADSNVFAAVCTDDDTPTGELSAAQTKEQTAAVATAESEAPTEIIYHQRA

SEQ ID NO: 64 - protein, 110 aa, Mycobacterium leprae
VSIPQSNTSLSAVIAVDQFDPSSGGQGVYDTPLGITNPPIDELLDRVSSKYALVIYAAKRARQINDHYNQLGEGILEYVGPLVEPGLQEKPLSIAMREIHADLLEHTEGE

SEQ ID NO: 65 - protein, 156 aa, Mycobacterium leprae
MTAQLDRDDWDVELRPYWTPLFAYAAAFLIAAAHITVGLLLRIKSSGVVFRTADQVAIGALGLVIASAVLLLTRPRLRVGAAGLLVRNIMFYRIIPWSHVVDVSFPLGSHWARIDLPDDEYIPLMAIQAVDKERAVEAMDAVRALLARYRAGPYGP

SEQ ID NO: 66 - protein, 77 aa, Mycobacterium leprae
MELALQITLVVTSILVVLLVLLHRAKGGGLSTLFGGGVQSSLSGSTVVEKNLDRLTLFVTGIWLVSIIGVALLTKYR

SEQ ID NO: 67 - protein, 265 aa, Mycobacterium leprae
MSRVLTLVITPYSKAMLKESIEAANGASHKYPNRIIIAMRVNSYANKARLDAQLWVGADTGAGVVVSRTLAVYAHSVVISILLPDIPMVAWWPNIAPTMSGQDSLGKLAIQRITNATNSIDPLATIKSRLSDYTADDTHLAWDLITYWRALLTSAVNLPPHEPIDLALVSGMKTEPALDVLAGWLANRINRPLRRAVADLKVELIRNSETIVLSRPQTWVTSTLIRTVKPDALVPWGAQGSRGVPSRKSATTGSRQVLLQCLRRH

SEQ ID NO: 68 - protein, 371 aa, Mycobacterium leprae
VLVLWRCFRVAMISALMVAVACLPDWLSGFLTGGLIAGSSARRATIYGVSNKFSSLHLVLGNEELLVERAVGEVLRSARQRAGTQDVPVSRMRAGDVGTYELTELLSPSLFADERIVVLEAAAEAGKEAAALIVSAAADIPQGTVLVVVHSGGGRAKALANELQSLGATVHPCARITKLSERTDFVRKELRSLRVKVDEGAVTALLNAVGSDVRELASACSQLVADTAGDVDADAVQRYHSGKAEVKGFDIADKAVGGDVSGAVEALRWAMMRGEPLVVLADALAEAVHTIGRVGPLSGDSYRLASRLGMPPWRVQKAQQQARRWSRDTVAAAMRVVAALNADVKGAAADAYYALESAVRKVAELAADGSR

SEQ ID NO: 69 - protein, 108 aa, Mycobacterium leprae
MAELLNTEDAKLVVLVRAAMARTEAGSGAVVRDFDGRTYAAAPVTLSTLELIGLQEEAAAAFSASSVVSGLEVGVLVAGSVDEPDIAMVRELASTAVVILIDRNGNRV

SEQ ID NO: 70 - protein, 479 aa, Mycobacterium leprae
VAHSGSPVSTVDGVANPPFGFSSGNDSPNDESGRDKHGKNGPDSGSSGSDPLASFGMSGDFGMSDLGQIFTHLGQMFTNAGTAMTADKQLGPVNYELARRVASSSIGFVAPIPATTSSAIGDAVHLAETWLDGVTALPAGTTKAEGWTPDDWVNNTLETWKRLCDPMAQQISTVWAASLPEEAKSMASPLLSMMSQMGGMAFGSQLGQAFGQLSREVLTSTDIGLPLGPRGVAAIMPQAVESFADGLEQPRCEILTFLATREAAHHRLFSHVPWLASQLLGAVEAYAAGMKIDMNGIEELARDFNPASLSDPTAIEELLGQGVFEPQATPAQTQALERLEALLALIEGWVQVVVTAALGDRIPGAAALGETLRRRRASGGPAEQTFATLVGLELRPRKLREAAVLWERLTQAAGVDARDAVWQHPDLLPSGKDLDDPASFIDRIIGGDTSGIDEAIAKLDLDRGNSDGRTPGSGGPVDN

SEQ ID NO: 71 - protein, 158 aa, Mycobacterium leprae
MFLRLMLSALKALQRLGAVMNSLARIDHWIWLFRCQPLTIRLLVATAALFTAATAFEVPAEADAIDDTFIKALNHAGVNFGEPRSAMTMGHYVCPILAKSGGNFAAAVQRIRGNSDMSPQMAETFAKIAISIYCPTMMANVASGNLPSLPPGPGIPGI

SEQ ID NO: 72 - protein, 423 aa, Mycobacterium leprae
MVADLVPICLSLPAGDRYTVWAPRWRDGGDEWEAFLGKDDNLYACETVADLVAFVRTDSDNDLVDHPAWKDLTSVHAHKLDPSEDNQFDLVVVEELVAEKPTAESVTTLAATLAIVASIGSVCELPAVSKFFNGNPSLGAVSGGIEHFTGRAGQRRWNSIAEIIGRSWDDVLSAIDKVISTPRVNAAMSAKAADELAEEPVEPEVEPDDEDGADSATAQANNSDDTEDESRTAGDTVVLGSDKDFWLQVGIDPVRIMTGAGTFYTLRCYLDDHPIFLGRNGRISVFSSERALARYLADEHDHDLSYLSTYDDIRTAATDGSLAIDITDDNIYVLSGLSDDLADGPDAVDRDQLDLAVELLRDIGQYSEESAVDTALETNRPLGKLVAHVLSPSAVDKPVAPYSAAVREWEKLEQFVESRLRLE

SEQ ID NO: 73 - protein, 84 aa, Mycobacterium leprae
VSAANDGSETNKLPTTQNPHIQITKGQPTDQELAALIVVLSSIGGASQVKQPEPTRWGLPVDKLRYPVFSWQRITLHEMTHMRR

SEQ ID NO: 74 - protein, 172 aa, Mycobacterium leprae
MRYPGNTLVAGEQVVLHRHPHWKRLIWPAVVLILATGLVSFGSGYVNSTHWAQVAKNVIYGVLWGVWLVIVGWLTLWPFLNWLTTHFVVTNRRVMFRQGTLTRSGVDIPLARINSVEFRDRLFERMFRTGTLIIESASQDPVEFYNIPRLRQMYALLYHEVFDTLGSEESPS

SEQ ID NO: 75 - protein, 228 aa, Mycobacterium leprae
VSFPDATITRLPTVLQPYAQRYHELIKFAIVGGTTFIIDSAIFYTLKLTILEPKPVTAKVVAGIVAVIASYVLNREWSFRDRGGRERHNEALLFFAFSGIGVLLSMAPLWFSSYVLQLRAPTVSLTVENLADFLSAYIIGNLLQMAFRFWAFRRWVFPDAFARNPEKTLESALTAGGIAEVFEDAIDGVFEDFGDALLRAWRNRSRRLDLSPASQLGDSSEPRVSKTS

SEQ ID NO: 76 - protein, 92 aa, Mycobacterium leprae
MVQGLLAKAATMVITGLTGVTAYEMLRKAVTKVPLHQIAVSALELGLRGSRKAEEAAESARLKLADVMAEARERIGKETTAPAVSDIHQHDH

SEQ ID NO: 77 - protein, 167 aa, Mycobacterium leprae
VSNSCSSSRHGQWSRRFSSRRAAKRGRDIRGPLLPPTVPGWRSRAERFDMAVLEAYEPIEQRWQGRVSELDVAVDEIPRIAARNPENVQWPPEVIADGPIALARLIPAGVDVRSNATRARIVLFRKPIERRAHDTVELGELLHDILVAQVAIYLDVEPSAIDPTMDD

SEQ ID NO: 78 - protein, 165 aa, Mycobacterium leprae
MRVSGASATFSHDSLSVVNVPRRCCRPGCPHYAVATLTFVYSDSTAVVGPLATVREPHSWDLCVDHAARITAPRGWELVRHAGPLPSNPDEDDLVALADAVREGPGGEHGSYGNGARASLGGFADPQLQSAGAHATVPSGGLLAPSELRSGRRRGHLRVLPDPSD

SEQ ID NO: 79 - protein, 365 aa, Mycobacterium leprae
VNATRLIDLEDTKGLIAADRDGLLRAASSAGAQVRAIAAAAEEGALETLRAHDRPRTVIWVAGRGTAETAGAMLAATSGGATTEPIVVASEAPPWVGPLDVLIVAGDDPGDPALVGAAATAVGRGARVVVVAPYEGPLRDATAGRVAVLEPRLRIPNEFGLCRYLAAGLAALQTVDPRLRLDLAMLADELDSEALHNSVGYEVFTNPAKTLAASVSGHRVALAGDCAATLALARHGSSVLLRIAHQVTSATGLSDAVVAVRSSVDVADYAPTSVDVLFHDEEIDGSLPERLRVLALTLASERTVVAARVVGLDDVYLVAAEDVPDGPSGLAGLPVSGGADRAEQELAMLAVRLEMAAVYLRLVRG

SEQ ID NO: 80 - protein, 85 aa, Mycobacterium leprae
VAGCGVFATRWSDACTAELSVAAGEPRVVSLCVDPLVPVVVLGRYVGARRQAILAMKEHGRRNLVALPTRQCVSRLGSCTLPGRG

SEQ ID NO: 81 - protein, 173 aa, Mycobacterium leprae
VDRVIALLSSGAIVGPCDYADVVTLPHKRAVFSRAPAAVRGAGLIVVVQGAVALVVAAALVVRGLTGADQRIVNGLGTAIWFVVVGVAVLAAGCALLVGKRWGRGLAVFTQLLLLPVAWYLVVGSHQSAFGFPMGIVALIALILLFSPPAVRWSAGAYQRSVASSANRKADSR

SEQ ID NO: 82 - protein, 407 aa, Mycobacterium leprae
MVRPERRTKADTIAAMTITVVMAAMVSLIWWTSDAQATHSRPATIPAPNPTPAREVPTAFNQLWAAASPATTAPVVVGGAVITGDGHQIDGRNPVTGESRWSYARDSDLCGVSWVYHYAVAVYRDDRGCGQVSTIDGSTGRREAARSSYADPHVRLSSDGTAVLSAGDTRLELWRSDMVRMLAYGEIDARVKPPARGLHSGCTLESTAASSSAVAVLEACANQDDLQLVLLRPGKEDDEPQQHLVAEPRVRSGSGARVLTVSDTHTAVYLPGEAGTQPRVDVIDETGTTVASTLLTKPPSSSAVVSQAGNLVTWWTGDTLMVFNQSNLTLRYTIAAGETTAPVGPGVMMAGQLLVPVTGKIGVYDLFSGANNRYIPVRRPPSSSAVIPAVSGSTVFEQRGDTLVALG

SEQ ID NO: 83 - protein, 195 aa, Mycobacterium leprae
MRLTETTSIRRTTTTSYSGHPIVDGRQVAALLGSVAALCAIATAVIINSGDNATTKAIVGAPTPRPVLTTPSIPLPATPSSTPPLLLLPDTATATIPHKAAPPALHPRTVVYNVTGMKELLDLVTVVYTDARGYPKTEFNVVLPWTKAVVLNLGVKTQSVVATSFHSQLHCSIVNAEGQPVVASTNNAVIATCTR

SEQ ID NO: 84 - protein, 82 aa, Mycobacterium leprae
VEVKIGITDSPRELTFSSAQTPGEIEELVSAALREGLGLLVLTDERGRRFLIHGAKIAYVEIGVADARRVGFGIGAESATNG

SEQ ID NO: 85 - protein, 341 aa, Mycobacterium leprae
VSSPGPVGSPGRVPVLREEWRAPLRAQREPLARGEGRVRVNRGRSRRWRKQTRLGRFVSVFGWRAYALPFLMALTAVVLYQTVTGTNAPEPAASEPITEPPVIGAVGTAIMDVPPRGLAAFDANLPAGTLPDGGAFTEAGDKTWHVVPGTMPQISQSATKVFKYSIEIENGLDPTMFGGDGAFAQMVDQTLANPKGWTHNPQFAFTRIDTGMPDFRISLVSPLTIRAGCGYEFRLETSCYNPSFGPDRQARVLINEARWLRGALPFEGDVGSYRQYVINHEVGHAIGYVRHEPCDKQGGLAPVMMQQTFSTSNNDGAKFDPEWVKPDGKTCRFNPWPYPIA

SEQ ID NO: 86 - protein, 297 aa, Mycobacterium leprae
LRSPRSGSTRLTRVTVEPPPEHVLSAFGLTGVQPVPLGASWEGGWRCGEVVLSMVADNARAAWSARVRETLFVDGIRLARPVRSTDGRYVVSCWRANTFVAGTPEARHDEVVSAAVRLHEATGKLERPRFLTQGPTARWADVDIFIAADRAAWEGRPLQSVPSGVWAAPMTTDGQRSVDLINQLAGLRKPTRSPNQLVHGDLYGTMLFVGTAAPGITDITPYWRPASWAAGVVVVDALSWGEADDGLIERWNALPEWPQMLLRALMFRLAVHALHPRSTAEAFPGLARTAALVRLVL

SEQ ID NO: 87 - protein, 100 aa, Mycobacterium leprae
VRQDGASRTVVGGTALIRYVIVLGLGYVLGAKAGRRRYEQIVGIYRTLTGSPMAKSMIAEGRRKVANRISPDEGFVTLAEIDNQTTVIERSAEWRENGGN

SEQ ID NO: 88 - protein, 250 aa, Mycobacterium leprae
MAKPRNAAAHKAARAEAKAARKAASRQRRLQLWQAFTIQRTEDKRLIPYMIAAFSLMVSASVTAGVLVGGLTMITLILLGVVLGALVAFIIFGRRTQQSVYHKAEGQTGGAAWALDNLRGKWRVSPGVAANGHFDAVHRVIGRPGVIFVAEGSAARVKPLLAQEKKRTARLVGDVPIYDIIVGNGDGEVALVKLERHLARLPANISVKQVDILESRLAALGSRAGASLIPKGPLPNAGKMRGVQRTVRRK

SEQ ID NO: 89 - protein, 124 aa, Mycobacterium leprae
MMAGEEAYLPPRDQGPVRRYIRDLVDARRNALGLFTPSALVLLFITFGVPQLQLYMSPAMLVLLSVMGIDGIILGRKISKLVDVKFPSNTESHWRLGLYAAGRASQMRRLRVPRPQVEHGSSVG

SEQ ID NO: 90 - protein, 171 aa, Mycobacterium leprae
MLPPAVSYPRRRSKRLIISVLVAIALVAAMTAVIIYGVRTNGSKTGGTFSEVTAKTAIEDYLKALEQSNINTIARNALCGMYDSVRDQRPDQALAQLSSDAFRKQFSQVELTSIDQIVYWSPYQAQVLFTMRTSPATGGPKRRQIQGIAQLLYRRNQVLVCSYMLRTADSH

SEQ ID NO: 91 - protein, 139 aa, Mycobacterium leprae
MHIEARLFEFVAVFFVIMAVLYGVLTSMFATGGVDWVGTTALALTGGLALIVATFFRFVARRLDIRPEDYEGAEISDGAGELGFFSPHSWWPVLVALSGSVAAVGIALWLPWLIVAGVVFVLASAAGLVFEYYVGPEKH

SEQ ID NO: 92 - protein, 212 aa, Mycobacterium leprae
MMNRYSPYRRGSDTIASDVIDRILVGVCAAVWLVLIGVSVAAAVALEDLGRGFHKIASDPHTTWVLYGIIVVSVLIIAGAVPVLLWARRVARVEPPIRPAGVPERGGVRQLVSAGRSTARIEVERVCAEERVQSVAQPGEWFDAAVDRIWLRGTVGLTGTMGAALVAVAASTYLMAVGRDGASWVGYVLAGIVTAVMPVIEWIYVRQLRRVG

SEQ ID NO: 93 - protein, 135 aa, Mycobacterium leprae
MNSTNSIQIADETYVAADRALIGAAVADRSSWHRWWPDLRLQVVEDRAEKGIRWAVTGTLTGTMEIWLEPLTEELDGVVLHYFLHAEPAGVAAWQLAKMNMAKVTHRRRVAGKAMAFEVKKTLERSRSIGVSPVI

SEQ ID NO: 94 - protein, 144 aa, Mycobacterium leprae
VADKTTQTFYIDANPGEVMKTIADIESYPQWISEYKEVEVLEVDDEDFPKRARMLMDAKIFKDTLIMSYDWTADHQSVSWILESSSLLKSLEGSYRLVPKGSTTEVTYELAVDFAIPMIGMLKRKAEHRLIDGALKDLKKRVEG

SEQ ID NO: 95 - protein, 130 aa, Mycobacterium leprae
MSGGYADIGPELRKLAQMTLDGIGPAVRSAAALVAGARGTGKCQQAWCPVCALTALVIGEQHPLLTVIADHSVALLDVIRAIVDDIDQSNKIPPDSPHGGGLDTETPAQTNTSNGTVRRRYQPIPVSVED

SEQ ID NO: 96 - protein, 171 aa, Mycobacterium leprae
MRYFYDTEFIEDGRTIELVSIGVVAEDGREYYAVSNEFDPERAGNWVRVNVLSKLPPLASQLWRSRRQIRLDLEEFFGVDGSEPTEPIELWAWVGAYDHVALCQLWGPMPDLPEALPRFTREIRQLWEDRGCPRMPPRPRDLHDALVDARDQLRRFRIIMSADDVGSLPTH

SEQ ID NO: 97 - protein, 134 aa, Mycobacterium leprae
VGSIPAGDDVLDPDEPTYDLTQVAELLGIPVSRVHRKLCEGYLVAVRRGDSLVVPQIFFTNSGAVVKSLPGLLTILHDGSFHETEIVRWLFTPDPSLTLTRDGSRDVVSNARPVDALHTHQAREVVRRAQAMAY

SEQ ID NO: 98 - protein, 239 aa, Mycobacterium leprae
VRARFPPLFTRGCTAQRRRTLTIALLLVAMVPLATGCLRVTASITISPDNLVSGKIIAAAKPKNKNDAGPQLNDNLPFSQKIAVSNYNSDGYVGSQAVFSDLTFAELPQLANMNSSTTDVTLSLRRNGNLVILESRADLTSVTDPDADVELTVAFPGVVTSTNGDRIETKVVAWKLKPGVVSTMSARARYTDPDTRSFTGAAVWLGIASFSAASVVVLLAWNERKSSARLQIPRDSSSS

SEQ ID NO: 99 - protein, 210 aa, Mycobacterium leprae
LAIFLINLSPNEMERRLNEALEVYVDAMRYPRNTENLRAGIWLEHIRRPGWQAVAAVEVRIEVADVADMADGPAHPAPSADELNNAPLRGVAYGYPGAPGQWWQQQVVQGLQRSGLSTLEIARLMNSYFELTELHIHPHTQGRGIGEALTRRLLAHRRENNVLLSTPETNGETNRAWRLYRRLGFMDIIRRHYFAGDPRAFAILGRTLPL

SEQ ID NO: 100 - protein, 134 aa, Mycobacterium leprae
MPLSDHEQRMLDQIESALYAEDPKFVSSVRGGGLRVPTARRRTQGAALFVIGLGMLVCGVAFKATMIGSFPILSVFGFVVMFGGVLFAITGSRLSGREDHPGLAPGTSRQRRSKGAAGSFTSRMEDRFRRRFDE

SEQ ID NO: 101 - protein, 377 aa, Mycobacterium leprae
MKAQRDTPIRRGDSGRPGGRDGAARSGKRTANEAGSRRLRTHAGKISASAREVGVPKSGPRTSPMSRPVERPARPRNTTQAKARAKARKAKAPKVVRPRLGECLIARLALIDLRPRTLVNKVPFVVLVISSLGVGLGLTLWLSTDSAERSYQLGDAREQARMLQQQKEALERDVREAESAPALAETARKQGMIPTRDTAHLVQGPGGNWVVVGTPKPADGVPPPPLNTKLPDAGPPSLKPPEIPLEVPVRVVPGPGGPPPPARSGPQMWLRVPDGATTLGGQHLPQELPQLPGMLNGPAAAQVQVPGFMPTPGLPIPGSTMRVPVPAPAPTEVPVRLQPGLVSPAVTSPVISTSPVPTPVNSEQFGPVTATAPGTSR

SEQ ID NO: 102 - protein, 210 aa, Mycobacterium leprae
MSTLHKVKAYFGMAPMEDYDDEYYDDRSPTHGYGRSRFEEGYGRYEGRDYSDLRGDPTGYLPLGYRGGYGDEHRFRPREFDRPDLSRPRLGSWLRNSTRGALAMDPRRMAMLFDEGSPLSKITTLRPKDYSEARTIGERFRDGTPVIIDLVSMDNADAKRLVDFAAGLAFALRGSFDKVATKVFLLSPADVDVSPEERRRIAETGFYAYQ

SEQ ID NO: 103 - protein, 96 aa, Mycobacterium leprae
LALFYQILGLALFVFWLLLIARVVVEFIRSFSRDWRPNGVTVVILETIMSITDPPVKLLRRLIPQLTIGAVRFDLSIMVLLLVAFIGMQLALSAAA

SEQ ID NO: 104 - protein, 130 aa, Mycobacterium leprae
MLIIALVLALIGLVVLVFAVATSNLLMAWVCIGASVLGVLLLIVDAVREHQCIDAANNEDKEDTDQDDGAVYVDYLDEVPAGTSTEAPDAGSQEGDTNSGELSGYWGRLTIDTGEQSAVAADDHDNDRAT

SEQ ID NO: 105 - protein, 149 aa, Mycobacterium leprae
VAIAELTEASVQGVENIRTVEVFLAALQDAGLRNRIRDVGRQPRVYQNVGLPTIHGRSKTITLWRKMADCIGFEIKIHRIAAVAIAVLCERADAVIVGPLWMQFWVCGTFEVQNKRIMLWRNYFDLFDLFKATMRSLVALRIPSLNAAF

SEQ ID NO: 106 - protein, 67 aa, Mycobacterium leprae
LAGVRLTEFHERVVLRFGAAYGASVLVDHVLTGFDGRTVAQAIEDGVELRDVWRALCVDFDVPRDQW

SEQ ID NO: 107 - protein, 209 aa, Mycobacterium leprae
MNEEPNIVDFPDSNPLQAALEAEELRVVREIDSGAKIFVLIAVLVFMLLGSFILPHTGQVRGWDVLFDSHGAGAAAVALPLRIFAWLSLVFGVGFSMLALMTRRWVLAWIALAGAAMASIVGLLAVWSRQTVAVGQPGPGVGLIVAWITLILLTFHWARVVWSSTIVQLATEEQRRRVVAQQQSKTLLDGLYSAGNRDTRTRSDPQVGS

SEQ ID NO: 108 - protein, 232 aa, Mycobacterium leprae
VLSAIAIVPSAPVLVPELTGAAAAEVADLRSAVLAVAACLPPCWIVVGTGRADDVVGPGGCLGTFAGFGADVRVRLSPQVGGEAELLVDFPVCALIAAWVRGQSQLDASAQVRVYCGDHDPDMALACGRQLRVEIEQAPDPIGVLVVADGATTLTSSSPGGYDPSAADAELVLDDALASGDVAALTRLSCQISGRVAFQVLAGLVEPGPRLAKELYRGAPYGVGYFVGVWQP

SEQ ID NO: 109 - protein, 91 aa, Mycobacterium leprae
MPDPVVMPVPCPTSGFTQYSPYYRGAQITLLQQTILAKLNQKYYNNRYRVDVEMVLSHTGVEADSAASHTILGLSSSILPPYGCRTKKQRS

SEQ ID NO: 110 - protein, 164 aa, Mycobacterium leprae
MLVIYAVPPLIGNVRHPMSRPILGPRCGSGESAGSRRPAPSRSASAPMRYSGASVAMLVAPHRGRTVSLAKTIGLALLAGMITLWLGLMADVSQVIDGDATGFVTHVPNRLAVVRVEAGESLQDVAARVAPDAPVRQVSERIRELNVLDSSMLVAGQTLIAPVG

SEQ ID NO: 111 - protein, 326 aa, Mycobacterium leprae
MSHSHYQDPDDEQHYQPGQPGMYVLEFPAPQLLASDGRGPVLIHALEGFSDAGHAIRLAATHLKAALNTELVASFAIDELLDYRSRRPLMTFKTDHFTHYDDPELSLYALRDSVGTPFLLLAGMEPDLKWERFITAVRLLAERLGVRQTISLGTVPMAVPHTRPITLTAHSNNGELIADFTPWITEIQVPGSASNLLEYRMGQHGHEVVGFTVHVPHYLTQTDYPAAAQALLEQVAKTGALQLPLSALAEAAAEIRAKIDEQVQASTEVAQVVAALERQYDAFIDAQENRSLLRRDEDLPSGDELGAEFERFLAQQAEKKRDDDLT

SEQ ID NO: 112 - protein, 139 aa, Mycobacterium leprae
VGKLSTAPNRGTTDTFDDNSRPVLITTAAPSYEEERRTRVRKYMTLMAFRIPALMLTTVAYSAWHNGLISLLIVAASVPLPWMAVLIANDRPLRRTEEPRRFDSRRRRTPLLLTTEQPAFKSLRRPPPKPTSLATDSRS

SEQ ID NO: 113 - protein, 107 aa, Mycobacterium leprae
VSGFCFSVGRVRRHNVTMLGRHNVTMLGMQTQTIEHTYTDEHVDDGTGSDTPKYFHYVKKDKIVESAVMGSHVVALCGEVFPVTRAAKPGSPVCSDCKRVYDMLKKG

SEQ ID NO: 114 - protein, 216 aa, Mycobacterium leprae
VVTQITEGTAFDKHGRPFRRRNARPAIFVVVFLVIVAGVSWTIALTRPAKVREPEVCNPPTQSTGSVPTQLGKQVPRTEMTDVTPAKLSDTKVHVLNASGRDGQAADIAGALRDLGFAQPTAANDPMYADTLLNCQGQLRFGTAGQATVAAVWLVAPCTELLHDNRTDDSVDLALGTDFTALAHNDDIDAVLASLRPGATEPSDPALLQKIHANSC

SEQ ID NO: 115 - protein, 100 aa, Mycobacterium leprae
MPTDYDAPRRTETDNVPEDSLEELKARRNEAASAVVDVDESESAESFELPGADLSGEELSVRVIPKQADEFTCSSCFLVQHRSRLASEKNGVMICTDCTA

SEQ ID NO: 116 - protein, 157 aa, Mycobacterium leprae
VSGTPVAPHNVRYRERLWVPWWWWPLAFALASLIAFEVNLSGATLPSWLPFAVAAGTLLWLGRVEIQVIADAPLGGSVELWAGNAHLPITAIAQSAAISRSAKSAALGRQLDPAAYVLHRAWVGPMILVVLDDPDDPTPYWLVSCRHPERVLSALRS

SEQ ID NO: 117 - protein, 273 aa, Mycobacterium leprae
VTADDDAERSDEDGAAVMATFGKRTGKDGASRTLTEPADPEATELPAASEPDSEEVDELEGPFDIDDFEDPAVAVLARLDLGSVLIPLPEGSQLQVELTDVGVPNAVWVVTANGRFTITAYAAPKTGGLWREVAGELADSLRNDSAKVTVKDGPWGREVVGTNTGVVRFIGVDGYRWMIRCVVNGPLETIDVLSEEARAALADTVVRRGDTPLPVRTPLPVQLPEQMAEQLREAAVAQQSAQHADARQQSRELAPRRGAAGSAMQQLHNTTGG

SEQ ID NO: 118 - protein, 232 aa, Mycobacterium leprae
VAVDLRNVTTVLLPGTGSDDDYVYRAFSGPLHRVGAAVLTPPPQPNRLIDGYLSALDDAARAGPIGVGGVSIGAAVAAAWALAHPERAVAVLAALPAWNGAPESAPAALAARYSASHLRRDGLAATTLQMQASSPPWLADELARSWCGQWPLLPDAMEEAAAYIAPSCAELARLATPLGVAAAVDDPIHPLQVGVDWVTAAPHAALQTVTLNQIGTNAAALGTACLAALALT

SEQ ID NO: 119 - protein, 184 aa, Mycobacterium leprae
VSHEYWSTAVSCNPGIHHIVRLDVAHTPRTTQTYRHSMLAEDIAEDFPAISINSSALDAARMLAEHGLPGLLVTDMSDKPYAVLPASQVVRFIVPRYIQDDPSLAGVLNESTADQAAEKLSSKKVRDVLPDHLVNVSPVNADDTIIEVAATMSRQRSPLLAVVKGGQLLGVITASRLLRAALKH

SEQ ID NO: 120 - protein, 196 aa, Mycobacterium leprae
VAPVTAAEPTPFREAVAAMNAFTVRPEIELGPIRPPQRLAPYSYALGAQVKHPELDIVPEQSEDNAFGRLILLYDPDGSDAWDGTIRLVAYIQSDLDSREAIDPLLPEVAWSWLIEALESRIDHVTALGGTVTATTSVRYGDISGPPRAHQLELRASWTATTPEVGVHVKAFCEVLEHAAGLPPAGVIDLGSRSRS

SEQ ID NO: 121 - protein, 99 aa, Mycobacterium leprae
MPLFLNAEPQALTAAANTLEGLSAATVASNAAAAQLTTEIAPPAADDVSILLAHFFSGHGRQYQAHASQGATNHQDLIQSLLTSSSAYAGTETANHDSL

SEQ ID NO: 122 - protein, 100 aa, Mycobacterium leprae
MTAAHFMTDPQAMRDMARKFDMHAQNVRDESHKMFMSSMDIAGAGWSGTAQLTSHDTMGQINQAFRHIVTLLQDVRDQLGTAADRYEHQEENSRKILSGS

SEQ ID NO: 123 - protein, 95 aa, Mycobacterium leprae
MGNINYQFGEIDAHGAAIRAQAAALETTHQAILATVRDAAEFWGGQGSTAHEMFIADLGRNFQMIYEQANSHGQKVQRASSSMADTDRSVSSAWS

SEQ ID NO: 124 - protein, 114 aa, Mycobacterium leprae
VALVLLYLVVLVLVAIVLFGAASLLFGRGERLPPLPRGTTATVLPAHGVTGADVDAVKFTQVLRGYKPSEVDWVLDRLGRELEALRGQLAAIADAEADADVSNVPSGDDGQDVT

SEQ ID NO: 125 - protein, 75 aa, Mycobacterium leprae
MLGAEWVREGGPARVWREHTMAAMKPRTGDGPLEATKEGRGIVMRVPLEGGGRLVVELTPDEAAALSDELKGVTS

SEQ ID NO: 126 - protein, 139 aa, Mycobacterium leprae
VMADRGQVFRRVFSWLPAQFASQNDAPVGAPRRFGSTEHLSVEAIAAFVDGELRMNAHLRAAHHISLCAQCAAEVDDQSRTRAALRDSHPIRIPSTLFGLLTAIPRCSPDYTSPVSEPFSEGSVSDRFVDGVAREQGKR

SEQ ID NO: 127 - protein, 120 aa, Mycobacterium leprae
VFANIGWGEMLVLVVVGLVVLGPERFPGAIRWTLGALRQTRDYLSGVTNQLREDIGPEFDDLRGQFGELQKLRGMTPRAALTKHLLDGDDSLFTGNFDRPAAAKQQDRDHHQTPFDTDAT

SEQ ID NO: 128 - protein, 285 aa, Mycobacterium leprae
MRVGRLAALLLAGVGVFVAGGCATDRGDRHPELVVGSKPDSESTLLAAIYVAALRSYGFGARGETGADPMAMLDSGGFTVVPGFTGKVLQILQPRAAVLSAARVYRAMVSALPEGIAAGDYTTAAEDKPTLVVTPDTAKAWSGSDLSLVLSHCNELVVGIVAGTHTPSAVGSCRLPAAREFPDYPTMFAALRAGQLTAGWTTTANPDLPADLIVLTDGKATLIQAENVVPLYRRNVLTDRQMLAINEVAGVLDTAALIEMRRQVIRGADSQAIADGWLAEHPMGR

SEQ ID NO: 129 - protein, 224 aa, Mycobacterium leprae
LAQVIERSVWIQGPAAEAYVARLRRTHPSASPTEIVAKLEKHYLAALTASGAVVGSVATLPGIGTLAAVSANAGETVFFLEATAVFVLTIASVYGIPANHRERRRALVLAVLAGDDTRLTIGELIGPGRTNGGWLLEGMASLPLSTWSQLHTRMLRYAAKRCTVRRGALMFGKILPIGIGAAVGGAGNRVVGKKIISNTRNAFGTAPSRWPATLILLPTVHNAG

SEQ ID NO: 130 - protein, 1152 aa, Mycobacterium leprae
VFVTDETIVYSASDLAAASRCEYALLRDFDARLGRGPVVATTEDELFARTSALGADHEQRHLDQLRHEFGDAVAVIGRPAYTYAGFAAAAEATQRAIANRAPAVYQAAMFDGRFVGFIDFLVRDGEQYRVVDTKLARSPKVTALLQLAAYADALAHSGVPVAPEAELRLGDGMVVSYRICDLIPVYRSQRSLLQRLLDRHYTAGTAVRWQDDEVRSCFRCPQCTEQLRATDDLLLIAGMRISQRSKLLNVGITTIAELADHSGPVPDLSSSALSELTAQAKLQVQQRNTGTPQFEIVDPQPLALLPDPDPGDLFFDFEGDPLWTVDGQEWGLEYLFGVLDSEISGTFRPLWAHNRVEERKALTEFLKMVTKRRKQRPHMHVYHYAPYEKTALLRLAGRYGVCEDEVDELLRSGTLVDLYPLVSKSIRVGAESFSLKALEPLYMGKQLRSGDVTTATDSITCYGRYCELLSAGNFDEAATVLKEIEDYNHYDCRSTRELRNWLLLQAYEAGVVPVGAQPVPEGNTVKDDDELSAILSALSGFTGDVAVGDRTPEQTAIALVAAARGYHRREDKPFWWGHFDRLNFPVGEWADNTDVFVADDASIIIDWHTPPRARKPQRRVRLRGRLARGNLGSAVFALYDPPAPLAMDVHPGRRAAGRAEVVEADDLSIPTEVVIVERVGNDGNTFHQLPFALTPGPPIATTALRDSIESTATTLAASLPQLPRTALIDILLRRIPRTHSGATLPRGTDTVADITAAVLDLDSSYLAVHGPPGTGKTHTAAHVITQLVSNHSWRIGVVAQSHAAVENLLDGVITAGLDARQVAKKRHDRSAPPWQEIDGNDYPTFIADPMGCVIGGTAWDFANRNRVPPGSLDLLVIDEAGQFCLANTIAVAPAAANLMLLGDPQQLPQVSQGTHPEPVNTSALDWLVEGQRTLPNERGYFLDRSYRMHPAICAAVSTLSYEGKLHAHTEYTAARRLNEYQPGVHVLAVHHQGNSTESPEEAGAITAEIERLLGTPWTDEHGTRPLDVSDILVLAPYNAQVALVRQQLMSAGFSGVRVGTVDKFQGGQAPVVFISMTSSSVEVVPRGISFLLNRNRLNVAVSRAQYAAVIVRSETLTEYLPATPVGLIDLGAFLTLTTFNGTGRLESRLDKP

SEQ ID NO: 131 - protein, 202 aa, Mycobacterium leprae
VRDVWSLPCRKSLLGVAAVVLVSGTLTGCSSGDSTVAKTPVPPSTTTGTISTIISSAPSPPFATAAPPTSNTPPDDPCAVNLASPTIARVVSELPRDPRSAQPWNPEPLAGNYNECAQLSAVIIKANTNAVNPTTRAVLFHLGRFIPQGVPDTYGFNGIDPAQTTGDTVALTYPSSIDGLATAVRFHWNGNAVELISNIAGG

SEQ ID NO: 132 - protein, 229 aa, Mycobacterium leprae
VLSGGAGSIPELNAQISVCRACPRLVDWREEVAVVKRRAFADQPYWGRPVPGWGSEQPRLLIVGLAPAAHGANRTGRMFTGDRSGDQLYAALHRAGLVNLPISMDAADGLQANQIRITAPVRCAPPGNAPTQAEWVTCSPWLEAEWRLVSEYVRAIVALGGFAWQIVLRLPGVSAMRKPRFSHGVVAQLYAGVRLLGCYHPSQQNMFTGRLTPAMLDDIFRDAKKLAGI

SEQ ID NO: 133 - protein, 188 aa, Mycobacterium leprae
VRCDVRALALAARGLIELMIVIPMVAGCSNAGSNKSVGTISSTPGNTEGHHGPMFPRCGGISDQTMSQLTKVTGLTNTARNSVGCQWLAGGGIVGPHFSFSWYRGSPIGRERKTEELSRASVDDININGHSGFIAVGNEPSLGDSLCEVGIQFQDDFIEWSVSFSQKPFPSPCGIAKELTRQSIANSK

SEQ ID NO: 134 - protein, 187 aa, Mycobacterium leprae
MRLSVRGRRSVFAGVAVLVSAALVVTGCSRSIGGTAVKAGSHDVPRNNNSQQQYPNLLKECEVLTTDILAKTVGADSLDIQSTFVGAICRWQAANPASLIDITRFWFEQGSLANERKVADFLKYKVENRSIAGVDSIVMRPDDPNGACGVASDAAGVVGWWINPQASGIDACGQAIKLMELTLATNS

SEQ ID NO: 135 - protein, 161 aa, Mycobacterium leprae
MRHAKSSYPRGFPDHIADHDRRLAPRGVREASLAGGWLRTNVPAIEKVLCSTAMRARETLTHSGIEAPVRYTERLYRADPDTVIKEIKAISDEVTTSLIVSHEPTISAVALALTGSGTNNDAAQRISTKFPTSGIAVLNVAGRWQHLELESAELVAFHVPR

SEQ ID NO: 136 - protein, 383 aa, Mycobacterium leprae
MRFLHTADWQLGMTRHFLAGDAQPRYSAARRDAVAGLGALAAEVGAEFVVVAGDVFEHNQLAPQVVSQSLEAIRAIGIPVYLLPGNHDPLDASSVYTSALFTAECPDNINVLDRAGVHQVRPGLEIVAAPWRSKAPTTDLVAEMLGGLTADIVTRVLVAHGSIDVFDPDRDKPSLIRLAGIDDALAGGAVHYVALGDRHSLTQVGSSGRVWYSGSPEVTNFDDIESNSGHVLVVEIDENDPRRPVTVTARHVGHWRFFTLHWQVDNGRDIADLDMNLDQMMDKDRSVVRLALTGSLTITDRAVLDACLDRYARLFAWLGLWERRSDLAVIPADGEFTDIGIGGFAAAAVDELVATAREGDTESAIDAQAALALLLRLADRGVA

SEQ ID NO: 137 - protein, 873 aa, Mycobacterium leprae
MKLHRLALTNYRGTARREIEFPDRGVILVCGANEIGKSSMIEALDLLLEFRDRSTKKEVKQVKPANADIGSEVCAEISSGTYRFVYRKRFNKKCETALTVLAPHREQLTGDEAHERVRAMLAETVDNDLWHAQRVLQAASTAAVDLSGCDALSRALDLAAGDHAELSGTEPLLIERIEAEYRRYFTSTGRPTGEWAVAISRLSDAETAVGECAAAVAEVDDRVRRHAVLTERVAGLAQQRFAAGPRLAVAQAAADKVAVLTRQAREAELVAAAATATNAAAVAAHTSRLRLLAEIDTRAVVLAATQDEAQEAVDAVSTMRADAEASDAAVEESTEALMAAQQRADIARSTVDQLVDRQEADRLSTRLAKIDAIQGERDLICAELSAVTLTEQLLQRIENAAAIVDRTGEQLKLISAAVEFTATADIEISVGQQRVSLEAGQSWSTTATGPTEVEVLGVLTACVIPGATALDAQSKYVAAQEELSVALADGGVVDLAAARCANQRRRELQSSLDQLSAALAGVCGDDQIDQLRARLEQLRDGYPGEPDLLAVDIGSARAELEAAETVRAAVDFEREVCRRTAAAANCRLVETSARANFLLKKAETQRAELDQDIDQLAQQRASVSDEDLASAAEAGLRAVQIAEQRVAKLTEELVAAEPEAVTAELVAATAAAESLRDQHEDAAGALREISIELSVFGTEGRQGKLDTAEAEREHAISQHTQIGRRARAAQLLRSVMARHRDTTRLRYVEPYRTELQRLGRPVFGPTFEVDIDSDLRIRSRTLDGITVPFESLSGGAKEQLGILARFAGATLVAKEDNVPVVVDDALGFTDPDRLAKMGEMFDTVGAHGQVIVLTCSPDRYDGFTGAHRIDLNV

SEQ ID NO: 138 - protein, 153 aa, Mycobacterium leprae
VTTPAQDAPLVLPAVAFRPVRLFIINIVLTGLAMLAAGLSGHLMVGVFFGIGLLLGLLNALLVRCSVESITAQGHPLKRSMALNSASRLAIITVFGLIIAYAFPLAGLGVVFGLALFQVLLVLSTMLPVWRKFRFGEADGGVLKGSEGEEQQR

SEQ ID NO: 139 - protein, 147 aa, Mycobacterium leprae
MSAPMVGMVVLVVTLGAAVLALSYRLWKLRQGGTAGIMRDIPAVGGHGWRHGVIRYRGEAAAFYRLSSLRLWPDRRLSRRGVEIVARRGPRGDEFDIMTDKIVVLELRDTTQDRRSGYEIALDQGALAAFLSWLESRPSPRTRRRSV

SEQ ID NO: 140 - protein, 301 aa, Mycobacterium leprae
MAGAVDLSGLKQRARQKASTSDPASRATLGARGTGSSENTSVIEITEANFEDEVLVRSHEVPILVLVWSPRSDACVKLLETLSGLAVADSGTWLLATVNVDAVPRVAQIFGVDAVPTVVALAAGQPLSSFQGMQSVDQLRRWLDSLLSVTAGKLRGPTRSEDSAEIDPAIAQARQQLEAGDFLTAKQSYHAILDADPASVEAKAAIRQIDFLTRATAQHPDAVAVADAAPGDIAAAFAAADVQILNQDVTAAFERLIVLVRSTSGDERSSVRTRLIELFELFDPDDPNVIVGRRNLANALY

SEQ ID NO: 141 - protein, 195 aa, Mycobacterium leprae
VRKWKRVETANGPRFRSVVAPHEVALLKHLVGALLGLLNERESSSPLDELEVITGIKAGNAQRPEDPTLRRLLPDFYTPDDKDQLDPAALDAVDSLNAALRSLHEPEIVDAKRSAAQQLLDTLPESDGRLELTEASANAWIAAVNDLRLALGVILEIDRPAPERVPAGHPLSVHFDVYQWLTVLQEYLVLALMAT

SEQ ID NO: 142 - protein, 119 aa, Mycobacterium leprae
MTRPETPQAPDFDFEKSRTALLGYRIMAWTTGIWLIALCYEIVSHLVFHHEIRWIEVVHGWVYFVYVLTAFNLAIKVRWPIGKTVGVLLAGTVPLLGIIVEHFQTKDVKTRFGLRHSRT

SEQ ID NO: 143 - protein, 126 aa, Mycobacterium leprae
VSTTRRRRPALVALVTIAACGCLALGWWQWTRFQSASGTFQNLGYALQWPLFAGFCLYTYHNFVRYEESPPQPRHMNCIAEIPPELLPARPKPEQQPPDDPALRKYNTYLAELAKQDAENHNRTTT

SEQ ID NO: 144 - protein, 95 aa, Mycobacterium leprae; identical to SEQ ID NO: 123

SEQ ID NO: 145 - protein, 100 aa, Mycobacterium leprae; identical to SEQ ID NO: 122

SEQ ID NO: 146 - protein, 421 aa, Mycobacterium leprae
MFDFAALSPETNSTRMYLGPGSSPILTAAAAWVVLAKELTAAAQGLQSAVEALLTTFEGESAAALAERVTPYEKWLTQNAASAELTATQLTVAANAYETAFTMTVPPLMVFVNRAQACLLIMSNIFGQNSTAIAEKEAEYTEMWIQDAAAMTSYQASVLEAVGATKAFTAPPLGVNEVGLAQEVVEEVVEEVVEEVVEEVVEAEQAISQAALDQAVNEGMEATVVPQVDQQVNVDVATPQTAVPDSSSAAAPQLWGGFAQHLSPINDTLSMINNHAGMANAGLSLVNGMGSAMKSLAPTTTKAAESAFKAMGSAVQSTGRGLLGSSSGGHVTAQLGRAASIGSLRVPQTWTTASQPVTAATRALSPARVAVATESESAPLLGGGLPMAPMVPGGGSGTGGVNTALRLQPRAFVMPRNPAAG

SEQ ID NO: 147 - protein, 99 aa, Mycobacterium leprae; identical to SEQ ID NO: 121

SEQ ID NO: 148 - protein, 239 aa, Mycobacterium leprae
MSVSRRDVLKFATVTPGLLGLGVAAAALCAVPASTAGSLGTLLDYAAGVIPASQIRATGAVGAIRYVSDPRGTWAVGKPIQVTEARDLINNGLKIVSCYQYGKGNTADWLGGATAGLRHAQRGVQLHTAAGGPVSAPIYASIDSNPTYEQYKQQVAPYLRSWESVIGHQRTGVYANSRTIAWALQDGLASYFWQHNWGSPKGYTHPAANLHQVEIDRRTVGGVGVDVNTILKPQFGQWA

SEQ ID NO: 149 - protein, 80 aa, Mycobacterium leprae
VVQDLPTPIGAGIYNIYTGVKHRDELAGASMPTVAQLGLEPPRFCAECGRRMVVQVRPDGWRAKCSRHGQVDSVDMEAKR

SEQ ID NO: 150 - protein, 198 aa, Mycobacterium leprae
VTEHCASDISDVSCPPRGRVIVGVVLGLAGTGALIGGLWAWIAPPIHAVVGLTRTGERGHDYLGNESEHFFVAPCLMLGLLTVLAVTASVLAWQLRQHRGPGMVIGLAIGLMICAATAAAVGALLVWMRYGALNFDAVPLSYDHKVAHVIQAPPVFFAHGLLQVAATVLWPAGIAALVYAVLAAANGRDDLGGRLCSR

SEQ ID NO: 151 - protein, 358 aa, Mycobacterium leprae
MKRLLATTLAALTVGTVSGFGSTVASSEPGEPWLPPSPVPVRENSPAKIVYALGGARPPTFDWDYYTIRAGDEFFPDVNRKLIDYPARAPFRYVPTFLVPGPRDEVTIGEAIAVATKNLNQAIHRGTEPAAVVGLSQGSLALDTEQEQLATDPTAPPPDQLTFNTFGDPSGYHGFGKSVLASIFRPGDYIPLIDYTMPQRMDSQYDSNRVVAAYDGLSEFPDRADNLLAQLNCFAGGAISHTPSGFFNPEDVPPQNIRTTVNSRGAKTTTYLIPVNHLPLTLPLRYLGWSDALVDQIDAVLQPKIDAAYAYNDNPLNKPISVDPVNGMDPIAGIDAELRDSILNVFAQLRSILPPPPG

SEQ ID NO: 152 - protein, 230 aa, Mycobacterium leprae
MWITILLMAIAISLEPFRIGMTVLMLNRPRPTLQLLVFLCSGFTMGMTVGFVVLFVFRRRLMASMQLTLPKVQILIGVLALLVAAVLTVQVCISSEPPAESPVDSASGPPKPSKWAPRPLARLLNGDSLWVAGVAGLGIALPSVDYLAALAVILTSGAAATTQVGALLMFNVVAFALIEIPLAAYLLAPDTTRAWTAALNNWIRSRRRLEVATLLAGVSCLLLAVGIAGL

SEQ ID NO: 153 - protein, 491 aa, Mycobacterium leprae
MADSVEGIGPFDELGALDYLLHRGEANPRTRAGIMAVELLDTTPDWNRFRSRIEDVSQRVLRLRQKVVVPTLPTAAPRWVVDPDFELDFHVRRVRVPDPGTLREVFDLAEVIQQSPMDVSRPLWTATLVEGLAAGRAAMLLQISHAITDGVGSVEMFAEMYDLERDPPSRPRSPQPIPQDLSRNDLMLQGINHLPVALAGGVVGGLSGVASVAGRAILRPASTVSGVVGYVRSGIRVLSQAAEPSPLLRQRSLATRTEAIEIQLSDLHKAAKAGDGSINDAYLAGLVGALRRYHEALGVSISTLPMAVPVNVRTEADVVGSNRFVGVTLAAPLGTNDPAARMQKIRSQMTQRRDEPAMNIIGSLAPLMTVLPASVLDFIVDSVASSDVNASNIPAYPGDTYFAGAKILRQYGIGPRPGVAMMAVLMSRGGFCTVTVRYDRASVKSEALFARCLLEGFDEVLALAGDPTPHAVPASFAARSSGSPAGWLSSS

SEQ ID NO: 154 - protein, 1622 aa, Mycobacterium leprae
MTIDPGATHVAELCTTFTQGADVPDWISKAYIDSYRGSHGDVREAPETSRVNPNALVTPAMLSAHYRLGQCRPNGRNCVRVYPADDPAGFGPALQIVTDHGGMVMDSITVLLHRLGVTYTAMMTPVFMVLRSPTGELLGVEPRASSTSHSIEGTWVGEVWIYIQLLPAVDSKSLAEVEQLLPRTLVDVQRVAADAAALNATLSGLAADVKTNKEGHFSASDRDDVAALLHWLGNGNFLLLGYQRCRVHYGLVSCDRSTGLGVLRARTGSRPRLTDDNELLVLAQAAVGNYLRYGAYPYAIAVREYDDGGDGGIIEHRFVGLFTVAAMNADVLEIPSISHRVRAALAMANSDPIYPGQLLLDVIQTVPRSELFTLSAERLFTMAKEVVDLGSGRRALLFLRADRLQYFVSCLVYVPRDRYTTGVRLQIEDILVREFGGTQVEFTARVSESPWALMHFMVRLSEGAATGSVDVSEGNRIRIQAMLSEAARTWSDRLIAAAASFSEGSVSYAEAEHYAATFSETYKQAVTPADAIDHIAIIKELADDSVKLVFFERKADGFAQLTWFLGGRSASLSQLLPMLQSMGVVVLEERPFTVARTDGLPVWIYQFKISPHPTIPLASTANERELTAKRFSDAVTAIWQGRVEIDRFNELVMRARLTWQQVVLLRAYAKYLRQAGFNYSQSYIESVLNEHPSTARSLVALFEALFDPSPLSSSTNCDAQAAAAAVAADIDALVSLDTDRILRAFASLVQATLRTNYFVTQKFSARSKGVLVLKLDAQLINELPLPRPKFEIFVYSPRVEGVHLRFGAVARGGLRWSDRLDDFRTEILGLVKAQAVKNAVIVPVGAKGGFVLKRPPLPTGDAAADRDAMRAEGIACYQLFISGLLDITDNVDHATGKVNAPPQVVRRDSDDAYLVVAADKGTATFSDIANDVAKSYGFWLGDAFASGGSVGYDHKAMGITAKGAWEAVKRHFREMGVDTQNEDFTVVGIGDMSGDVFGNGMLLSKHIRLIAAFDHRHVFLDPDPDAAVSWAERQRMFDLPRSSWDDYNKSLISEGGGVYSREQKAIPTSPQVRTALGIDGEVTEMAPPNLIRAILQAPVDLLFNGGIGTYIKAETESVADVGDRANDPVRVNANQVRAKVIGEGGNLGVTALGRVEFDLSGGRINTDAMDNSAGVDCSDHEVNIKILIDSLVTAGKVKVEERKHLLESMTDEVARLVLTDNEDQNDLIGTSRANAANMLSVHAMQIKYLVDERGVNRELEALPSEKEIQRRSEAGIGLTSPELSTLMAHVKLALKEQMLATELPDQDVFVSRLPRYFPKPLRERFTPEIRSHQLRREIVTTMLINDLVDTAGISYAFRIAEDIGVGPIDAIRTYVATDAIFGVGDVLRRIRAANLSVVLSDRMTLDTRRLIDRAGRWLLNYRPQPLAVGAEINRFAAKVKALTPRMSEWLRGDDQAIVEQQATEFVSQGAPEDLAYRVAVGLYRYSLLDIIDIADITELDPAEVADTYFSLMDRLGTDGLLTAVSKLPQNDRWHSLARLAIRDDIYASLRSLCFDVLAVGEPDESGEEKIAEWEHISASRVERARLMLAEIHASGEKDLATLSVAARQIRRMTRTSGRGSSG

SEQ ID NO: 155 - protein, 163 aa, Mycobacterium leprae
MGHQSSQSEVAPVVRGDVVTELPKGWVITTSGRVSGVTEPGDRSVHYPFPIKDLVALDDALTYSSRASHARFAVYLGDLGNDTAALAREILAQVPTPDDAVLVAVSPNQCAIEVVYGSQVRGRGAESAAPLGVAAASSAFEQGNLIDGLISAVRVLSAGISRS

SEQ ID NO: 156 - protein, 265 aa, Mycobacterium leprae
VMAPDIKSARAGRLTIQIAQLLLVVAAGALWMAARLPWVVIRSFDGLGPPKEVALSGASWSAVLLPLALLMLAATVAAIAVRGWPLRVLAGLLAVASFLVGYLGVSLWVLPDVTVRGAVLAHVSLLSLVGSQRHHLGAGAAVAASGCTLIAAVLLMRSASVIGSARQGTSKYVVPAQRRSIARRDGAATAISQMSERMIWDALDEDRDPTDRLREPDTEGRWWTACRRSLPFMNVVEIGGCTGSVAGRWVTSGKGNDTHVSGNCA

SEQ ID NO: 157 - protein, 111 aa, Mycobacterium leprae
MYRFGMRYLDSMTVTVDRHVAGNEFTVEEISTGIFASGYGQVGDGRSFSFHIEHWSLVVEIYRTRLAGLVPQTEEVVPRAIRGLVNIDLTDERSLAAAVRDLVARTLTVSG

SEQ ID NO: 158 - protein, 196 aa, Mycobacterium leprae
MARAIHVFRTPDRFVAGTVGQPGNRTFYIQAVHDSRVVSVVLEKQQVAVLAERIGALLLEVHRRFGTPVPPEPAEINDLNPLVMPVDAEFRVGTMGLGWDSEAQTVVVELLAVTDAEFDASVVLDDTDEGPDAVRVFLTPESARQFATRSNRVILAGRPPCPLCDEPLDPEGHVCARTNGYKRSALLGPKDDDTEW

SEQ ID NO: 159 - protein, 262 aa, Mycobacterium leprae
VLRNGELTVLGRIRSASNATFLCESTLDQRSVHCVYKPVSGEQPLWDFPEGTLAGRELSAYLVSTDLGWNIVPYTVIRDGPAGPGMLQLWVQQPGDVADSAPRSGPDMVDLFPADKLQSGYLPVLRSYNYAGDEVILMHADDTQLRRLAVFDVLINNADRKGGHILYGLDGHVYGVDHGVSLHVEDKLRTVLWGWAGKPIDNQTLEEVAGLADALSGPLADTLAGQITWAEIIALRRRAYAMLDNPVMPGPNRDRAIPWPAF

SEQ ID NO: 160 - protein, 274 aa, Mycobacterium leprae
VAAFEGWNDASDAASGALEHLNAVWEADPIVEIDDEAYYDYQVNRPVIRQVDGVTRELVWPAMRISYCRPPGSDRNVVLMHGVEPNMRWRTFCTELLTIADRLNVDTVVILGALLADTPHTRPVPVSGAAYSPESARRFGLEETRYEGPTGIAGVFQDACVAARIPAVMFWAAVPHYVSHPPNPKATVALLRRVEDVLDVEVPLADLPTQAEDWEQAITEIAAEDDELAEYVHSLEQRGDAEVDVNDALGKIDGDALAAEFERYLRRRRPGFGR

SEQ ID NO: 161 - protein, 194 aa, Mycobacterium leprae
VSRWTHRTFFIALSAIVTTAGFGSSGCAHGNSSTSESAVPSTFPGISSSITAPPATGLPAPEVLTNVLSRLADPNIPGIDKLPLIESATPDSAVTLDKFSNALRDNGYLPMTFTANNIAWSNKNPSDVLATISVNIAQTNNSVFSFPMEFTPFPPPQQSWQLSKRTADMLLEFGNSSGLTNPAPIKAPTPTPSH

SEQ ID NO: 162 - protein, 63 aa, Mycobacterium leprae
MAQEQTRRGGGGDDDEFTSSTSVGQERREKLTEETDDLLDEIDDVLEENAEDFVRAYVQKGGQ

SEQ ID NO: 163 - protein, 272 aa, Mycobacterium leprae
MSEPQGSDPGKQWQSPGEGVENHSSDQPTQAASPWQQQPSTQDSTWHPPAYASPECYNYPQLTEPVYPHQYPSATPGYGQPGYFGAQFSQCGIPGQYPQSGSPGQYGSPGQYGPPGQYGPPGQYGPPGQYGPPGQYGPPGQYGPPGQYSQQFQPYEQPGTKGFVALIGSIAGVIGVLIFAAILVTGFLWPAWLVTTKLDVNKAQASVQQVLTDETNGYGAKNVKDVKCNNGADPTVKKGDTFDCSVSIDGMQKRVTVTFQDDKGTYEVGRPQ

SEQ ID NO: 164 - protein, 440 aa, Mycobacterium leprae
VYGALVTAADSTQTGLRNWLLAVFHPRTHTPSTATIVRSALWPAAILSVLHRSTVITTNGNITDDFKPVYRAVLNFRHGWDIYNEHFDYVDPHYLYPPGGTLLMAPFGYLPFAPSRYLFILINTGAILIAWYLILRLFKYTLSSVAAPTLLLAMFCTETVTSTLVFTNINGCIMLLEVLFLWWLINGSEPKTVSQQWWAGGAIGLTLVLKPLLGPLLCLPLLNRQWQALVPAIALPVVINLAALPLVSHPMDFFTRTVPYILGTRDYFNSSIEGNGVYFGLPTWLIVFLRLLFTVLAICSLWLLNRYYRTRDPLFWFTCSTGVLLLWSWLVLPLAQGYYSMMLFPFLMTVVLPNSLIRNWPAWLGIYGFLTLDRWLLFNWMRYGRALEYLKITYGWSLLLIVVSTVLCFRYLDAKAENRLDHGIDPAWLTAERERASVNA

SEQ ID NO: 165 - protein, 61 aa, Mycobacterium leprae
MTIDPDQIRAEIDALLAQLPDFADLEDSVSGLSLAQLEEVALRFSEVHSVLLQALESAEKG

SEQ ID NO: 166 - protein, 393 aa, Mycobacterium leprae
MRMSALLSRNNSRPGLVGTARVDRNIDRLLRRICPGDIVVLDVLDLDRITADALVEADIVAVVNASPSVSGRYPNLGPEVLVNNGVTLIDETGPEVFKKIKDGAKIRLHEGGVYSGDRRLICGTERTDHDIADLMREAKSGLATHLEAFAGNTIEFIKSESPLLIDGIGIPDIDVDLRRRHVVIVADEPSAADDLKSLKPFIKEYQPVLVGVSGGADVLRKAGYRPQLIVGDPEQISTEALRCGAHVVLPADADGHAPGLERIQDLGVGAMTFPAAGSATDLALLLADHHGAALLVTAGHTANIETFFDRTRTQSNPSTFLTRLRVGEKLVDAKAVATLYRNHISFGAIALLALIMLIAVIVALWVSRTDGVVLHGVIDYWNRFSLWIQRLIA

SEQ ID NO: 167 - protein, 317 aa, Mycobacterium leprae
MISLRQHAFSLAAVFLALAVGVVLGSGFLSDTLLSSLRDEKRDLYTQISGLNDQKNMLNEKVSAANNFDNQLLGRIVHDVLGGTSVVVFRTPDAKDDDVAAVSKIVVQAGGTVTGTVSLTQEFVDANSTEKLRSVVNSSILPAGAQLSTKLVDQGSQAGDLLGITLLVNANPAVPNVGDAQRSTVLVALRDTGFITYQTYNRNDHLGAANAALVITGGLLPQDAGNQGVSVARFSAALAPHGSGTLLAGRDGSATGVAAVAVARADAGMAATISTVDNVDAEPGRITAILGLHDLLSGGHTGQYGVGHGATSITVPQ

SEQ ID NO: 168 - protein, 527 aa, Mycobacterium leprae
VTSIMSVSALEQSAADVGDNSARQHAHGALPDSLAIAMLATVISGAWASRPSLWFDEAATISASASRTVPELWRLLSHIDAVHGLYYLLMHGWFAIFPSTEFWSRVPSCLAIGAAAAGVTVFTRQFATRTTAVYAGIVFAILPRITWAGIEARSSALSVAAAMWLTVLLVASVQRNRPRLWLCYALTLMLSILLNLTLATLVLVYAVILPWLAPNKFRNSPFIWWAVTSVVALGTITPFILFAHGQVWQVDWIFRVSWHYVFDITQRQYFDHSVSFAIATAVIIVPAIATRLAGLRAPAGDLRSLVIICTAWIVIPTTLMVGYSAVIEPVYYPRYLILTAPAAAIVIAVCIVTVARKPWPIAGVLVLFAVAAFPNYLFTQRGRYAKEGWDYSQVADVISSQAAPGDCLIVDNTVPWRPGPIRALLAARPAAFRSLIDIERGFYGPTVGTLWDGHVPVWLVTAKINKCSTVWTVSDRDTSLPDHQAGQLLSPGLILGRAPAYQFPSYLGFRIVERWQFHYSQVIKSTR

SEQ ID NO: 169 - protein, 324 aa, Mycobacterium leprae
LPPSAKSTYPGQVEGAPHDGTPSAPQEPDEDTVTVPAPALIRRSSVSMPNAAQWLHTTNRSPRLVAMVRRARRLLPGDPDFGDPLSTAGEGGPRAAARAADRLLGDRGAASREVSLSVLQVWQALTEAIARRPVNPEVTLVFTDLVGFSGWSLQAGDEATLALLRQVARAVESPLLDAGGHIVKRMGDGIMAVFRDPSVAVQAVLAATEAMKSVEVGGYTPRIRVGIHTGRPQRLAADWLGVDVNIAARVMERATKGGIMISGPTLDLIPQSDLKELGIITRRVRKPMFTSKFTGIPPDMVIYRIKARRELTASDETAQTNSLT

SEQ ID NO: 170 - protein, 111 aa, Mycobacterium leprae
MADRVLRGSRLGAVSYETDRNHDLAPRQIARYRTDNGEEFEVPFADDADIPGTWLCRNGMEGTLIEGDLPEPKMVKPPRTHWDMLLERRSIEELEELLKERLDLIRSRRRG

SEQ ID NO: 171 - protein, 232 aa, Mycobacterium leprae
MTKIQIDAPDGPIDALLSVPPGPEPWPGVVVIHDAIGYEPDKESTNNHIAMAGYVAITPNLYSRGSRARCITRVMRELLTKRGRAFDDILATRDYLLAMPKCSGRVGIAGFCMGGRFALVMSPKGFDASAPFYGTPLPRNLSETLNGACPIVASFGGRDPLGIGAPKRLRQATQTRHITTDIKVYPDAGHSFANKLPGQPLMRITGFGYNQAATEDAWSRVFAFFDKHLRTD

SEQ ID NO: 172 - protein, 128 aa, Mycobacterium leprae
VTPTFADLAKAKYILLTTFTKDGRPKPTPIWAAADGDRLLAISAGKAWKVKRIRNNPRITLATCNVRGCATSAGVQGNATILDKLQTGSVYDAICKQYGIQGRLFNFVSKLRGGMQNNVGLELRVSGS

SEQ ID NO: 173 - protein, 123 aa, Mycobacterium leprae
MTDSPGEHGPQKPLPSADPWKSFAGVMAAILFLEAIVVLLALPVLGASGGLTLSALSFLIGLAGLLIVLVGLQRKAWAIWVNLGVQVVVLVGCAVYPVLGFVGVLFAGLWALIVYFRAEVSRR

SEQ ID NO: 174 - protein, 207 aa, Mycobacterium leprae
MPEKASVKYQADLWFDPLCPWCWITSRWILEVEKVRDVEVHFHVMSLAILNENREDLTENYLENITKAWGPARVVIAAEQANGASVLDPLYTAMGIRIHNEDNKNLDEVIKRSLADTGLPAELAAAAQSNAYDDALRESHHAGMDPVGDDVGTPTVHVNGVAFFGPVLSKIPRGEEAGKLWDASLTLAAYPHFFELKRTRTEPPQFA

SEQ ID NO: 175 - protein, 117 aa, Mycobacterium leprae
MRIVVLVLFAADGVLSAVVGAMLMPLYIGSVPFPISGLISGLVNAVLVWAARLWTRSPWLVALPLWVWLLTVGLLSLGGPGVDVVSGQSVMASGALWLILLGVSPPACVLWRCNRYG

SEQ ID NO: 176 - protein, 94 aa, Mycobacterium leprae
MTVLTDEQVDAALLDLNDWKHTDGALCRSIKFPTFLAGIDAVCRVAEHAETKDHHPDIDIRYRTVTFILVTHYADGITKKDITMARDIDRLIGD

SEQ ID NO: 177 - protein, 182 aa, Mycobacterium leprae
MATIWTYLRATAIVVGSSAALLTGGIAHADTAPAPAPAPAPAPAPALNIPQQLISSAANAPQILQNLATALGATPPVTPSAPGISFPGLTPAAATVPTSSAATLPSLPGIMAPAISNTPTTPGLPASTPGFPQARVDMPAMPFLPVSVPPQISLPGDLQALASSASAAAAPVAAPTLLSALP

SEQ ID NO: 178 - protein, 348 aa, Mycobacterium leprae
LKTGGFVTSAWNLPKGLVAVVTASTAAFGLCQNAAADPANPYGTPPNPTQQLPGLPALAQLSPIVQQAANNPQQATQLLMEAVSALTQNPTAPIASKNLATSVSQFMQEPNNPNPGASALDIPTSGVPAPAANGITPLDVVLVPHLPSAGAEPGAQAHLPTGIDPVHAAGPATAATPTPGSPTNRTAAPPTPVASPAPTTPELPATTPGFGPDAPPTQDFIYPSISTNCLADGSSSIATALSVAGPAKIPLPGPGPGQAAYVFTAVGTPGPADVQKLPLNVTWVNLTTGKSGSATLKPRPDINPEGPTTLTVIADTGSGSIMSTIFGQVTTKEKQCQFMPTIGSTVVP

SEQ ID NO: 179 - protein, 163 aa, Mycobacterium leprae
MRFGASLLRVRRRLYGMGSQVFDDKLLAVISGNSIGVLATIKRDGRPQLSNVQYHFDPRDLAVRVSITEPGVKTRNLRRDPRASILVDVDDGWSYAVAEGTAELTPPAAAPDDDTVEALIVLYRNIVGEHLDWDEYRQAMVTDRRVLLTLPILHVYGLPPGIR

SEQ ID NO: 180 - protein, 151 aa, Mycobacterium leprae
MTKTLLVVHHTPSPTTRELLEAVLAGANDSEIDGVEVVSRPALAATIPDMLNADGYLFGTTANFGYMSGALKHFFDTVYYPILDHVSGRPYGLWVHGNNDTVGAAVAVGKLATGLSLTHAADVLEVVGPVDAMVCERAHELGGTLAAMLME

SEQ ID NO: 181 - protein, 160 aa, Mycobacterium leprae
MNDTVMTKRSLYILYIQLLIAALCFAMLAYLVLLGRMAVAMIGSGQAAAVSLGLALLIMPVIGLWAMIATLRAGFAHQKLARLIAADGMELDTSVLLRRPSGRIQRDAADALFATVRAELAGDPDNWRCWYRLARAYDYAGDRRRAREAMKTALELHGRD

SEQ ID NO: 182 - protein, 401 aa, Mycobacterium leprae
MKAQRRLGLALSWSRVTTVFVVAIVVLVLASHVPELWQAGHHVAWCVGVGITVVVMVLVLVSYHGITLMSGLATWVWDCFADPRAALAAGCTPAIDHQRRFGRDVVGVREYKGRLVTVIAVDDGEDDPVGRHRHRTTPAGLPVQAVADGLRQFDIRLDSIDIVSVKIRRGGNAAKFSALDNWGSEEWGLVCACPPTYQRCTWLVLRMNPQHNVVAVAARDSLASTLVAATERLAQDLDGQNCAARPLAAGELAEVDSAVLADLEPTWSYPGWRHIKYVNGFATSFWVTPSDIDSETLNELWLSDLPDIKATVITIRLASRSCQTRLSAWVRHHSETRLSKEACRGLNQLTGRQLAAVRASLPAPATRPVLVVPSRELSDHDELVLPVGQGREGSASLFAGQ

SEQ ID NO: 183 - protein, 300 aa, Mycobacterium leprae
MDHQSTRTDITVNVDGFWLLQALLDIRHVAPELRCRPFVSTDSNDWLHEHPGMAVMREQGIVVNGNVNEHVATRMRVFAAPDLEVVALLSRGKLLYGAVNDENQPPGSRDIPENEFRVVLVRRGSHWASAVRVGNDITIDDVAIADSASITSLVMDGLESIHHADPAAINAVNVPLEEMLEATKSWQDAGFNVFSGRDLRRMGISAATVAALGQALSDPAAEAAVYARQYRDDAKGPSASVLSLKDSSSGRIAIYQQARTAGLGDAWLAICPATPQLVQLGLKTVLDTLPYGDWKTHSRV

SEQ ID NO: 184 - protein, 506 aa, Mycobacterium leprae
VAEESSGRRGSEYGLGLSTRTQVTGYQFLARRTAMALTRWRVRMEVEPGRRQTLAVVASVSAALLGCLGALLWSFISPSGQLNESPIIIDRDSGALYVRVGDRLYPALNLASARLITGRPDNPHAVRSSQIATLPHGPLVGIPGAPSELSPETPQTSSWLVCDTVATSTGIGSSSGVTVTVIDGSPDLSGHRRVLTGSDAVVLHYGGDAWVIRQGRRSRIDAMNRSVLLPLGLTPEQVSQARPMSRALFDALPVGPDLVVPDVPNEGNPASFPGAPGPVGTVIVTPQISGPQQYSLVLADGVETVSPLVAQIMQNAGKPGNTKLITVAPSVLVKMPVVNKLDLSVYPDTPLQVVDLRENPSTCWWWERTAGESRSRIQVITGSTIPINSADVKKVVSLVKADTTGREADQVYFGSNYANFVAVTGNNPAAQTTESLWWVTRTGARFGVEDTKDVRDALGLNGTPNLAPWVALRLLSQGPTLSRADALMEHDTLPMDMTPAELVVPK

SEQ ID NO: 185 - protein, 321 aa, Mycobacterium leprae
VAKQEPMCGVEPTLWAISDLHTGHVGNKPVAESLYPLSPDDWLIVAGDVAECTDEIRWTLELLRHRFAKVIWVPGNHELWTTNRDPMQIFGRARYDYLINMCDQMGVVTSEHPFPLWTERGGPATIVPMFLLYDYTFLPTGADSKAKGLAIARERNVVATDEYLLSSEPYATREAWCRDRLDVTRSRLEQLDWMTPTVLVNHFPLVREPCDALFYPEFSLWCGTTKTADWHIRYNAVCSVYGHLHIPRTTWYNEVRFEEVSVGYPREWRRRKPYSWLRQVLPDPQYAPGYLNDFGGHFVITSEMRAQAVQFRERLRQKQSR

SEQ ID NO: 186 - protein, 106 aa, Mycobacterium leprae
VRTCVGCRKRELAVELLRVVAPSTGKGSYAVIVDTASSLSGRGAWLHPDMQCVQQAIRRRAFTGALRIAGSPDTSAVVEHIEFLSELDRPGNRTGSKEHEHTVKSR

SEQ ID NO: 187 - protein, 178 aa, Mycobacterium leprae
MLLVPSAVPVINRRGVLAGGATLTVLGVCFSACSKSPSKTPEIEELLGPLDQARHDSALASAAAAAIGNLPQITAALAVVATQRAAHARALVTEISRATGKLASSSSDTTSPGLSPASPPSKPPPPVSDVIDALRTSAEGAGRLVSTASGYRAGLLASIAASCTASYTVALVSGGPSI

SEQ ID NO: 188 - protein, 165 aa, Mycobacterium leprae
MTSIEPSAPTPVATPKRTPVSQDSDNAGLSEALVVEHSTIYGYGIVLALSPPNANSLVVDALIQHRQRRDDIIVMLTARRVSPPVAASGYQLPMLVGSAADAARLAVRMENDGATAWRAVAEHAETADDRTFAAMALAQSAVMAARWNKMLGAWPITTTFPGSNE

SEQ ID NO: 189 - protein, 84 aa, Mycobacterium leprae
VASTEGEHNAGVDPAEVPSVAWGWSRINHHTWHIVGLFAIGLLLAMLRGNHIGHVENWYLIGFAALVFFVLIRDLLGRRRGWIR

SEQ ID NO: 190 - protein, 96 aa, Mycobacterium leprae
MTTHKAMTRVQLEAMGEVFAVDNLTRMGLRGLHCNWRCRYGECDVIASETAHRTVVSRLRSIAATVMEGSRRSAPEQKVRWLRWLAGLWPANQDEF

SEQ ID NO: 191 - protein, 101 aa, Mycobacterium leprae
MSAEDLEKYETEMELSLYREYKDIVGQFSYVVETERRFYLANSVEMMPRNTDGEVYFELRLADAWVWDMYRPARFVKQVRVVTFKDVNIEEVEKPELRLPE

SEQ ID NO: 192 - protein, 596 aa, Mycobacterium leprae
MTQSDHRHTRPSSYGGTVLTQRVSQATVEDSRPLRGWQRRAMVKYLASQPRDFLAVATPGSGKTTFALRVMTELLNSHAVEQVTVVVPTEHLKVQWTRAAATHGLALDPKFSNTNPRTSPEYHGVTMTYAQVAAHPTLHRVRTEGRRTLVIFDEIHHGGNAKAWGDAIREAFSDATRRLALTGTPFRSDDKPIPFVTYALDADGLMHSQADHTYSYAEGLADGVVRPVVFLVYSGQARWRNSAGEEHAARLGEPLSAEQTARAWRTALDPSGEWMPAVISAADQRLRQLRTHVPDAGGMIIASDQTAARAYANLLAQMTSETPTLVLSDDPGSSARITEFAKNTSQWLIAVRMVSEGVDIPRLSVGIYATSASTPLFFAQAIGRFVRSRHPGETASIFVPSVPNLLQLASELETQRNHVLGKPHRESTDNPLGGNPATMTQTEQDDTEKYFTAIGADAELDQIIFDGSSFGTATPAGSEEEAYYLGIPGLLDADQMRALLHRRQNEQLQKRTAAQQASSTPDRTSGAPASVHGQLRELRRELNSLVSIAHHHTGKPHGWIHNELRRRCGGPPIAAATHDQLKARIDAVRQLNAEPS

SEQ ID NO: 193 - protein, 232 aa, Mycobacterium leprae
LSKLDDELSRIAHRANYLPQREAYERMRVERTGANDRLVAVQIALEDVDTQVFLLESEIDAMRQREDRDRLLLNSGATDAKQLSDLQPEFGTWQRRKNSLEDSLREVMKRRGELQDQLTAELGAIERMQTDLVGARQTLDVAFAEIDQVGQPHSSQCDVLIAELAPALSAPYERLCAGGGLGVGQLQGHRCGACRSEIGRGELSCISVDVDDEVVKYPESGAIQLLDKGFFQ

SEQ ID NO: 194 - protein, 270 aa, Mycobacterium leprae
MRHLALLLRPGWIALTLVVTAFTYLCFMVLAPWQLGKNTRMSRENNQIEYSLNTPPVPVKTLLSHQDLSTSKSQWRQVTATGRYLPDVQVLARLRVVDSGQAFEVLAPFVVDDGPTVLVDRGYVRPEPGSHVPPIPRPPNEAVSITARLRDSEPVMKDKEPFSRDGVQQVYSINIEQVARLTKIPLAGSYLQLVDNQPGGLGVIDIPHLDAGPFLSYGIQWISFGIIAPIGLGYLAYAEIRTHRQEKLAKPSQAPMAVEEKLADRYGHPR

SEQ ID NO: 195 - protein, 140 aa, Mycobacterium leprae
VVAADHTPSFARKLGIQQGQVVQEWGWDEDTDDDIRASVEEACGGELLDEDTDEVVDVVLLWWRDGDGDLVDTLMDAITPRAEDGVIWVLTPKTGKPGHVPPAEIAEAAPTAGLMLTSSVNLGDWSASRLVQPKSRIGKR

SEQ ID NO: 196 - protein, 414 aa, Mycobacterium leprae
VNHNHFVPAPPRRLPLELLDTVPDSLLRRLKQYSGRLATEAVTAMQERLPFFADLEASQRASVTLVVQTAVVNFVQWMQNPHSDVSYTAQAFELVPQDLARRIALRHTVDMVRVTMEFFEEVVPLLARSEEQLTALTVGILKYSRDLAFTAATAYADAAEARGTWDSRMEASVVDAVVRGDTGPELLSRAAALNWDTTAPATVVVGTPTPNHDGPNGQVSSERASQEVREIAARHGRAALTDVHGTWLVAIISGQLAPTDKFFSDLLHAFSDGPVVIGPTAPMLTAAYHSASEAVSGMNAVAGWSGAPRPVQARELLPERALMGDASAIVALHTDVMLPLADAGPTLIETLDAYLDCGGAIEACARKLFVHPNTVRYRLKRITDFTGHDPTLPRDAYVLRVAATVGKLNYPTHH

SEQ ID NO: 197 - protein, 217 aa, Mycobacterium leprae
VTVALALRDGCRRISTMTRQYGVTTQRHLISPVVFDITPLGRRPGAIIALQKTVPSLARIGLELVVIEWGAPINLDLRVESVSEDVLVAGTVTAPTVSECVRCLTAVHGHVQVTLNQLFAYPYSATKVTTEEDAVGHVVDGTIDLEQSIIDAVGIELPFAPMCRSDCPGLCAECGTSLVVEPGHPHDRIDPWWAKLTDMLAPDVPQTSETDGSRSEW

SEQ ID NO: 198 - protein, 214 aa, Mycobacterium leprae
VSAQPVERPGDLKPAPASVLPMPVPTAWWVLIAGVIGLVASMMLTVEKIRILLNSAYVPSCNVNPIVACGSVMSTPQASVLGFPNPLLGIVGFTLVTVTGVLSVAEVSLPQWYWIGLAVGTLAGVGFVHWLIFQSLYRIGALCAYCMVIWAVSVSLLVVVTAIVFRPLLEVLPGRTSAIARGIYQWRWSIATLWFITVFLLIMVRFWNYWQTLL

SEQ ID NO: 199 - protein, 191 aa, Mycobacterium leprae
VTSNSDAGSAVDAGGPPRTVIIAAVVLTAATIGTILVLAATLHEPPQPVVITAVPAPQATTAACRSLTQALPQRLGDYERAPVAQPAPDAVAAWRTGSDTEPVVLRCGLDGPAEFVVGSPIQAVDQVQWFEVDAKPKPAIDAGRSTWYTVDRPVYVALTLPSGSGPTPIQELSDVIDRTLAAIPISPAQSH

SEQ ID NO: 200 - protein, 277 aa, Mycobacterium leprae
VTGQSHDEHWRRPGECPEPIPGRPASASLVDPEDDLTPVGYPGDFGTTTVIPYSDPDHLKGPGGTGYNLLDQQEPLPYVQPQARHAVAEPTEIDSDQDNERLHTVGRRGTQHLGLLVLRVGLGVVLAAQGLHKLFGWWGGQGLTGFKNSLTQVGYQHADILAYVSAGGEAVAGVLLVLGLFAPVVAAGALAFLINGLLAAWPHSPLFSFFLPDGNEHQITLIVMDVTVILCGPGRYGLDAGRRWAYRPFIGSFIVLIAGIAAGIAVWVLLNGVNPLA

SEQ ID NO: 201 - protein, 232 aa, Mycobacterium leprae
VEMPLTQRYATVLAVPSYLLRIELADRPGSLGSLAVALGSVGGDILSLDVVERSGGYAIDDLVIEVPSGAMPDKLITAFESLPGVRVDSVRPHSGLLEAHRELELLDQVAAADDNASKLQVLADEAPKVLRVSWCTVLRSSQGKLLRLAASVGAPETRANSAPWLPIERAAPLDGTAEWVPQSLRDMNTTMIAAPLGDPHTAVVLGRPGPEFRPSEVARLGYLAGIVATMLR

SEQ ID NO: 202 - protein, 337 aa, Mycobacterium leprae
MSVFATASGVGSWPGSSPYPAAKVVVGELAGALAHIVELPARGVGADMLGRAGALLIDVAIDTVPRGYRIAARPGAVTRRAFSLLDEDMDAFEAAWEMAGLRGRGRVVKVQAPGPITLAAGLELANGHRAITDSCAVRDLAESLAEGVAAHRAALARRLDTQVVVQFDEVSLPAALGGLLTGVTAFSPVAPLDETLAATLFDSCVATVGADVLLHSCAAELPWNFLQRSAIRAVSVDVNVLRTGDLDGIAAFVESGRTVVLGVVPATAPQRLPSVEQVAAAVVGVTDRLGFGRSALRDRIGVSPACGLAGATPHWACTAIELARKTAEAFAQDPDAI

SEQ ID NO: 203 - protein, 364 aa, Mycobacterium leprae
LAAGPALSARGYLAMNAQTQAGCSLMEWENNDNGRQRWCVRLVQGGGFGGPLFDGFENLYVGEPGTIFSFPMTQWTRWRQPVIGMPSTPRFLGNGQLLVTTHLGQVLVFDAHRGMVVGSPLDLVDGVNPTDPTRGLADCVSAQRGCPVASAPAYSPASQTVVLDIWQPGAPTAGLIGLKYHSRQTPLLARAWTSDAIGAGVLASPVLSADGSTVYVNGRDQHLWALHAANGKPKWSVPLEFLAQTPPTVTPQGLIVSGGGPDTRLAAFKDAGDHAQQIWRRDDLTPLSTSSLAGVSVGYTVVSSSPAADAPGMSLLAFDPRNGHTLNSYPLPAATGYPVGVSIANNRRVITVTSDGQLYSFAPT

SEQ ID NO: 204 - protein, 327 aa, Mycobacterium leprae
MTRSTEISANAVPNPHATAEQVAAARKDSKLAQVLYHDWEAENYDEKWSISYDQRCVDYVRHCFDAIVPDELFTELPYDCALELGCGTGFFLLNLIQSGVARRGSVTDLSPGMVKIATRNGQSLGLDINGRVADAEGIPYDDNTFDLVVGHAVLHHIPDVELSLREVLRVLKPGGRFVFAGEPTDVGNRYARVFADLTWKVTIRVVQLPGLSAWRRTQVEIDENSRAAALEWVVDLHTFEPKVLETMATNAGAVQVKTVTEEFTAAMLGWPLRTFESTMPPSKLGWGWARFAFTSWKTLSWVDANVWRRVIPKSWFYNIIITGVKPS

SEQ ID NO: 205 - protein, 170 aa, Mycobacterium leprae
MRASNQFADATAGVVYVHASPAAVCPHVEWALSSTLQTKANLVWTPQPAMPGQLRAVTNWTGPVGTGARLANALRSWSVLRFEVTEDPSPGVDGQRFSHTPQLGLWSGSMSANGDIMVGEMRLRAMMAHGADTLAAELDSVLGTAWDDALEVYRDGGDVGEVTWLSRGVG

SEQ ID NO: 206 - protein, 273 aa, Mycobacterium leprae
MVALDALDDWPVPTTAAAVVGPTGVLAARGDTEQVFPLASVTKPLVARAVQIAIEEGVVDLDTVAGPPGSTIRHLLAHASGLAMHSKYVMAPPGTRRIYSNYGFRVLAETVQREAGIGFSRYLTEAVLEPLAMTATKLEDGTWAAGFGATSTVADLAAFANDLLRPATVSAQIHAEATSVQFPDLDGVLPGHGVQRPNDWGLGYEIKNSKLPHWTGTLNSARTYGHFGQSGGFIWADPEAELALVVLTDRDFGEWALQLWPAISDAVISEYAR

SEQ ID NO: 207 - protein, 147 aa, Mycobacterium leprae
LGKIFIMLPTVTHQAITCTVRRVRWIVDAMNVIGTRPDCWWKDRRGAMVRLVGKLERWASTERNHVTVVFERPPSPSIRSSVIVIAHAPKAFPDSADDEIVRLVQADPEPQGICVVTSDSALTDRVQEVGALAYPAARFRKHIDSID

SEQ ID NO: 208 - protein, 190 aa, Mycobacterium leprae
MTGQDVVVQQPQTIPMLPIYIPQDVDMTVVKSEVAAAGVSASPAAMPGLLEVVSHAQAEGINLKIVLLDHNLPNDTPLRDIATVVGADYPDVTVLTLSPNYVGSYSTHYPRVTLEAGEDISKTGNPVQSAQNFLGELNVPEFPWTVLTIVLLIGVLVAAIGTRFMQLRSKRLATSLDAAGILAEDVNRAD

SEQ ID NO: 209 - protein, 166 aa, Mycobacterium leprae
VALKTDIRGMVWRYSDYFIVGREQCREFARAIKCDHPAYFSEDAAAELGYDAIVAPLTFVTIFAKYVQLDFFRNVDVGMETMQIVQVDQRFVFHKPVLVGDKLWARMDIHSVSERFGADIVVTKNSCTSDDGELVMEAYTTLMGQQGDNSSQLKWDKESGQVIRSA

SEQ ID NO: 210 - protein, 142 aa, Mycobacterium leprae
MARREFSSVKVGDLLPEKTYPLTRQDLVNYAGVSGDLNPIHWDDEIAKVVGLDTAIAHGMLTMGIGGGYVTSWVGDPGAVIEYNVRFTAVVPVPNDGQGAVLVFSGKVKSVDPDTKSVTIALSATTGGKKIFGRAIASAKLA

SEQ ID NO: 211 - protein, 159 aa, Mycobacterium leprae
VGLTTNIVGMHYRYPDHYEVEREKIREYAVAVQNEDTSYFEEDAAAELGYKGLLAPLTFICLFGYKAQSAFFKHANIAVTDQQIVQIDQVLKFVKPIVAGDKLYCDVYVDSMREAHGTQIIVTKNVVTNEVGDIVQETYTTLAGRVGEGGEEGFSDGAA

SEQ ID NO: 212 - protein, 71 aa, Mycobacterium leprae
MLKKVEIEVDDDLVQEVIRRYGLLGRREAVHLALKALLGEPGVGGLSEQDPEYDEFSNPDAWRTRRSSDTG

SEQ ID NO: 213 - protein, 263 aa, Mycobacterium leprae
VLDLEPRGPLPTEIYWRRRGLAVGITVIVIVIAAIVAVVGNGAAAQPANVDKPGSSQNHPGSATPKVLPPNGHEGNLAPAPPQGRNPESSTSTAAVQPPPVLREGDDCPDSTLAVKGLTNVPQYFLGDQPKFTMVVTNIGLVSCKRDVGAAVLAAYVYSLDNKRLWSNLDCAPSNETLVKTFTPGEQVTTAVTWTGMGSSPHCPLPRPAIGPGTYNLVVQLGNLHSMPVPFILNQPPPPPGSSGPALAPSPEAPPANVPVSGG

SEQ ID NO: 214 - protein, 167 aa, Mycobacterium leprae
LVDTVGLVNKCVPDSSGLPLRAMVMVLLFLGVIFLLLGWQALGSSGNSDDYSALPMSSMPNTPTTPAATSTSSTSAANQAEVRVYNISSKEGIAARTRDQLTTAGFKVTEVDNLVVSDVSATTVYYSDAEGEYATADAVGQKLGAPVEPRIAAITNQPPGVIVLVTS

SEQ ID NO: 215 - protein, 102 aa, Mycobacterium leprae
MDGAMARAHRAGDDVEIVDGLTRREHDILAFERQWWKFAGVKEEAIKELFSMSATRYYQVLNALVDRPEALAVDPMLVKRLRRLRASRQKARAARRLGFEVT

SEQ ID NO: 216 - protein, 410 aa, Mycobacterium leprae
MERPNEYMARQRSILNKVFTGFSAYCRYGQHVSKQQARSTVESTYRSILPNIPGVPWWAALLIATTASAIGYAIDAGNTDLTTVFTGFYITGCVAAVLAVRQSGLFTAVIQPPLILFCAVPAAYWLFHGSKIKSLKDLLINCGYPLIERFPLMLGTAGSVLLIGLVRWFFQLMYRTTASSNSEDDTVSKPNSLISGITAVLNSILCIYSNDQNHRANQDTADTELMHSDPPLRTRQTARDNRSARTHSGQARRVVEYTSEPLVEPWQHSSQRSSEQARDFDAGESPRRSRRQPTPQSDPELRSQPPREIRRDAYGHRSGPYEWPTNHSSHLEPYRRYKQPGPPEHFTEHGQLYERYKQPRRRATPPRASSVNPISQVRYRGSTARDDPRVDRQRSQTPRRPVTESWEFDV

SEQ ID NO: 217 - protein, 257 aa, Mycobacterium leprae
MVNDCPRSRSATWSWALAVNQQGWDTRRVTFEWQPNSEVANKPGSVSWSAKPRLLQDGRDMFWSLVPLVVGCILLAGMAGTCTFAPGGTTKSTVSSYDAAAALRADARALGFPVRLPELPTGWRSNSGSRGSIEDGRMDLSTGKRLPAVTSTVGYITPTGMYLSLTQSNADEDRLVASIHPSSHPTGTVDVAGTKWVVYQGSDQKKDHSGAAAEPVWTSRFASPVGAAQIAITGAGCSSQFRMLASATQSQQPLPAR

SEQ ID NO: 218 - protein, 155 aa, Mycobacterium leprae
MSNRKFSFEVTRTSSASAAVLFRLVTDGANWAKWAKPIVLQSSWARLGDLRPGGIGAVRKIGIWPILVREETVEYEQDRRHLYKLIGPPNPAKDYLGEVLLAPNAAGGTNIHWSGSFTENIPGTGPVMRAALKGAVRCLTVRLVKTAERESDGVQ

SEQ ID NO: 219 - protein, 237 aa, Mycobacterium leprae
MDCEVAREALSARLDGEREAVPSVRVDEHLGECSACRAWFDQVADQARDLRQLVDSRPAITPVDALGIVAPPRRRRPLMTWQRWALLCVGIAQIVLATVQGLGVSVGLTHDRAMSFGSYLLHESTAWSASLGVIMMAAVLWPGVAAGLAGVLTVFVGLLTVYVVVDVVAGATITLRILMHLPVAIGAVLAIAVWRHSSTPRPTFDDEVDVDLDIVLPRNASRGRRRGHLWPTDGSAV

SEQ ID NO: 220 - protein, 183 aa, Mycobacterium leprae
MSAELAPSLQNAAESTNTFPMAEDLLGSILEPYSYKGCRYLIDAQYRASPDSVFAYGNFGIEESAYIRGTGHFNAVELMLCFNQLGYSAYAQSVVNKDISALRGWSIADYCRNQLSGILIKNTSSRFKKLINPQKFSARLHVYDLRIVERTWRYLQLSNTIEFWDDNGGSAIGEFEVAILNIP

SEQ ID NO: 221 - protein, 78 aa, Mycobacterium leprae
VTETARERILTAVCEVLYIAESDLVDGDETDLRDLGLDSVRFTLLMKQLGLSQEAEMQSKLMDNFSIANWVRQLESST

SEQ ID NO: 222 - protein, 210 aa, Mycobacterium leprae
MIDDLLLRWVVTGLFVLSAAECGFACLACRRPWTLVPSNGLHFAMAIAMAVMAWPRGAQLPTTGTVVFCGLVGAWFVILATVSSRRIAERAAYAYPALMMLAMVWMYVIMDSHLHDHWATGHHTSPHTSMLGVDMTTTVVPASGIPGWISIINWLWFAFFCIATVFWTYRSFATSRRNAGFSRYCSLHPSGQAMMSTGMAIMFGVLLFHV

SEQ ID NO: 223 - protein, 153 aa, Mycobacterium leprae
MWLTAAPAAARFVVASVIAASCAASTGVAGADPQSPSAPKTTIDHDGTYAVGTDIAPGTYSSAGPVGNGTCYWKRIDNPDGPIDNAMSKKPKIVQIEASNKAFKTTGCQPWQQTSNTTVSTDLPGPIAGIQLESNLGILNGLLASNGQQVPRS

SEQ ID NO: 224 - protein, 174 aa, Mycobacterium leprae
MSGPSSSCRCLPCCPHDRSSQPRCGESLGWQGYGRVYLESPWPFGLKQILQILRYGAEYAGKILAQPSKPTDVSSGPRRKTQVFAKATVVPKILQPKETQMTFDPKNAVNAARDIATNFVEKASDIVENVSDIIKGDIAGGANDIVQNSIDIATHAVDKAKEIFIGKGEYDELE

SEQ ID NO: 225 - protein, 134 aa, Mycobacterium leprae
MIRELLAISAIASGAVNSAPRAAANPHYDGDVPGMSYDASLSAPCFSWERYIFGRGPSGQAEACHFPPPNQFPPANTGYWVISYPLYGVQQAGAPCPKTQAAAQSADGLPMLCLGGQGWQPGWFTDKGFFPPAG

SEQ ID NO: 226 - protein, 157 aa, Mycobacterium leprae
LDMPGEMLDVRKLCKLFVKSAVVSGIVTASMALSTSTGMANAVPREPNWDAVAQCESGRNWRANTGNGFYGGLQFKPTIWARYGGVGNPAGASREQQITVANRVLADQGLDAWPKCGAASDLPITLWSHPAQGVKQIINDIIQMGDTTLAAIALNGL

SEQ ID NO: 227 - protein, 151 aa, Mycobacterium leprae
MEGSVTVHMAAPADKVWNLIADVRNTGRFSPETFEAEWLDDVTGPALNAKFRGHVRRNEIGPVYWTTCKVTACEPGREFGFTVLLGNKPVNNWHYRLVTSGDGTYVTESFRFNRSPLLTVYWLLGGFLRKRRNIRDMTKTLRRIKDVVEAE

SEQ ID NO: 228 - protein, 85 aa, Mycobacterium leprae
MTNLWDLKQKVIYSIQWLVVNSLGHQLPRTMLETIRRKTGQPWRTAAGVHPVDNQFGMVCENSEYSDYVYNIKANTAVRTHKSKI

SEQ ID NO: 229 - protein, 99 aa, Mycobacterium leprae
MDVMAATEYLARSTTLTSVGWIGYIIIGGIAGWIAGKIVQGGGSGILMNIVIGVVGALIGGFLLSFFVNTAAGGWWFTLFTSILGSVILLWVVGRVRKT

SEQ ID NO: 230 - protein, 142 aa, Mycobacterium leprae
MAKLTRLGDLERAVMDHLWSRQEPQTVRQVHEALSARRDLAYTTVMTVLQRLAKKNLVSQIRNNRAHRYAPVHGRDELVAGLMVDALDQAEDSDSRQAALVHFVERVGADEADALRRALAELETHQRHVRHLVALQRTTEGD

SEQ ID NO: 231 - protein, 316 aa, Mycobacterium leprae
VSALAFTILAVLLVGPTPTLVARSTWPLRAPRAAMVLWQTIALAAALSTFSAGIAIASRVLMPGPDGRLTASVIGAAGRLGWPLWAAYVAAFALTVLVGARLIVAIVRVAIATRRRRAHHRMVVDLVGVGHNAALAQPCARARDLRVLEVAQPLAYCLPGVRSRVVVSEGALTKLNDTEVTAILTHERAHLRARHDLVLEAFTAVHAAFPRLVRSSAALSAVRLLVELLADDAAVRAAGRTPLARALVACASGQAPSGALAAGGNTTVLRVRRLSGRSNSAVVSAAAYLAAAIVLLVPTVALAVPWLTELQRLFNI

SEQ ID NO: 232 - protein, 733 aa, Mycobacterium leprae
MTKLGAEFKPDQTRINRKAANTGMGRHSMPDPEDSIDQPSNQFAASGPDQSDEIDHGYQSRMGYPEPVFEPAATGSPSYRSYPHGAEHPADSTPEALDETIDYQSYWAEDRNEDLFVDGAADDHPDFPPRPAGSSTSSQAPTSLSHLFKASHRSVGKWQGGHRSDGGRRGVSIGVIATLVAVVVLVGAVIMWSFLGHILNNRKHQAAARCVGGHQTVAVVADPSIADYLQEFAQSYNASARPVGDHCMMVTVKPVGSEAALTGFNDSWPANLGDKPALWIPGSSISAARLAVTADQKTISESHSLVTSPVLLAVRPEFEQALANKGWAALPGLQTNPNSLADLNLPAWGSLRLALPMNGNSDATFLAGEAVATASVPAGAPAIQGVGAVRTLMSAQPKLADSTWAEAMSTLLKPGDVATAPVHAVITTEQQLFQRGQSLSDAKSALGSWLPHGPAPVADYPAVLLNGSWLTQEQAAAASEFARFVQKPDQLAKLAKAGFRVNGVTPPSSSVTSFAAVPSTVSVGDDGMRATLVEEMIQPSSGVAATIMLDQSMPTDEGGKTRLANVVAALDDKINAMPPTSVMGLWTFDGHKGQTEVTTGQLADPVNGQPRSAALTAALDKQYSSNGGAVSFTTLRMIYQEMLANYHVGQTNSVLVITAGPHTDQTLDGARLQDFIRTSADPAKPIAVNVIDFGTDPDQATWKAVAQISGGSYQNLSTSASLDLATAINTFLS

SEQ ID NO: 233 - protein, 231 aa, Mycobacterium leprae
MTHLVTRARSARGNTVSEQPRQGQLDLADYRDTPTATTHGDIGLNGPTAVSGPAQPGLFPDDSVPDELVGYRGPSACQIAGITYRQLDYWARTSLVVPSIRGAAGSGSQRLYSFKDILVLKIVKRLLDTGISLHNIRVAVDHLRQRGVQDLANITLFSDGTTVYECTSAEEVVDLLQGGQGVFGIAVSGAMRELTGVIDDFRGERADGGESIAAPEDELASRRKHRDRKIG

SEQ ID NO: 234 - protein, 251 aa, Mycobacterium leprae
VSAPDSPALVGMSIGAVLDLLRSDFPDVTISKIRFLEAEGLVTPQRSASGYRRFTAYDCARLRFILTAQRDHYLPLKVIRAQLDAQPDGELPSFGSPYVAPRLFSVTGGPGAGVGSGVGSDIPAVSPAGVRLSREDLLDRSGVADDLLTALLKAGVITTGPGGFFDEHAIVILQCARALSEYGVEPRHLRAFRSAADRQSDLIVQIAGPIVKAGKAGARDRADDLAREVAALAITLHTSLIKSAVRGVLHR

SEQ ID NO: 235 - protein, 144 aa, Mycobacterium leprae
MIHRLRLGWLVAFFATIVLISVWIPWLTTKVNDEGWANAIGGTHGNLELPSGFGAGQLIVLLSSTLLVAGAMMGRGLSVKVASIAALIISLLIVVIVVWYYQLNVNPPVVAECGLYLGAAGAVCAMVCSVWAVIAAVAAGRSSL

SEQ ID NO: 236 - protein, 181 aa, Mycobacterium leprae
VTSRIKRMAKLTGSIDVPLPPNEAWMCASDLARFGEWLTIHRAWRSKLPEVVEKGTVIESYVEVKGMPNRIRWTVVRYKAPEAMTLNGDGVGGVKVKLIAKVSPKDDGSVVSFDVHLGGSALFGPIGMIVAVALRTDIRESLQNFVTAFSRPEPGLIRSRALVVDQHSRAVVEQRSASAGL

SEQ ID NO: 237 - protein, 56 aa, Mycobacterium leprae
VLDKAKDILVQNADKVETVLDKAGEFVDEKAKGKYTDTIYQVAEETKKAASFDTFG

SEQ ID NO: 238 - protein, 341 aa, Mycobacterium leprae
MARTRMVRRWRNNMEVRDDTDYVGMLTTLSEGSVRRNFNPYTDIDWESPAFAVKDNDPRWILPDTDPLGRHPWYLAQPEQRKIEIGMWRQANVAKVGLHFESILVRGLMNYTFWMPNGSPEYRYCLHECVEECNHTMMFQEMVNRVGADVPGMPRRLRWLSPLVPLVAGPLPVAFFIGVLAGEEPIDHMQKNVLREGKSLHPIMERVMAIHVAEEARHISFAHEFLRKRLTHLTKRQLFWVSLYYPLTMRVLCNAIMVPPKAFWQEFNIPREVKKELFFRSPESRKLLRDIFADVRMLAYDTRLMETRSARLMWHICKIDGQPSRYRGEPQRQHPATTSAA

SEQ ID NO: 239 - protein, 251 aa, Mycobacterium leprae
MRELKVVGLDPDSKTILCEGDIPGERFKLPADDRLRAAVRGDTTLLDQPQLDIQVTNMLSPKEIQARIRAGASVEQVAMASGSDIARIRRFAHPVLLERSRAAELATAAHPVLADGPAVLTLLETVSAALVKRGLEPDKLSWDAWRNEDSRWTVQLMWHAGRSDNLAHFCFTPGAHGGTVTASDDAANELIDPDFNRPLRPLARVAHLDFVEPATPATVTPDNQLVSSRRGKPTIPAWEDVLLGVRSAGQR

SEQ ID NO: 240 - protein, 91 aa, Mycobacterium leprae
MLVEPDRSREPPPLPSMLLEVWPVIMVGALAWLIAVVAAFVVSSLQSWRPVALAGLVVGLFGTGIFVWQLAAARRGARGAQGGLETYLDPR

SEQ ID NO: 241 - protein, 269 aa, Mycobacterium leprae
VTGPVEDSAVATVAEWPEELAAVLTNAADDARAAIEEFSGSVTVGDYLGVGYEDPNAATHRFLAHLPGYQGWQWAVVVAAYPGAEHATVSEVVLVPGPTALLAPEWVPWEQRVRPGDLGPGDLLAPTSEDLRLVPGYNASGDPAVDEIAAEIGLGRRWVMSVWGRSAAAERWHGGDYGPDSPMARSTKRVCRDCGFFLSLVGSLGAMFGVCGNEMSADGHVVDKLYGCGAHSDTPAPAGSGSSVYEPYDDGVLDILEPSTVQLPESPAD

SEQ ID NO: 242 - protein, 579 aa, Mycobacterium leprae
VSGRRRNHPGRLASIPGLRTRTGSRNQHPGIANYPADSSDFRPAQQRRALEQREQQAGQLDPARRSPSMPSANRYLPPLGQQQSEPQHNSAPPCGPYPGERIKVTRAAAQRSREMGYRMYWMVQRAATADGADKSGLTALTWPVVTNFAVDSAMAVALANTLFFAAASGESKSKVALYLLITIAPFAVIAPLIGPALDRLQHGRRVALATSFVLRTGLATLLIMNYDGATGSYPSMVLYPCALAMMVLSKSFSVLRSAVTPRVMPPSIDLVRVNSRLTVFGLLGGTIAGGAIAAGVEFVCAHLFKLPGALFVVAAITISGALLSMRIPRWVEVTAGEIPATLSYRLHRKPLRQSWPEEVKKVSGRLRQPLGRNIITSLWGNCTIKVMVGFLFLYPAFVAKEHQANGWVQLGMLGLIGTAAAIGNFAGNFTSARLQLGRPAVLVVRCTIAVTVLALAASVAGNLLMTTIATLITSGSSAIAKASLDASLQNDLPEESRASGFGRSESTLQLAWVLGGALGVMVYTDLWVGFTAVSALLILGLAQTVVSFRGDSLIPGLGGNRPVMIEQESMRRAAAVSPQ

SEQ ID NO: 243 - protein, 162 aa, Mycobacterium leprae
VQRRVTVLLPAVVMLLAAAAGFGVWLLVREPDPQRPEISVYSHGHLTRVGPYLHCNMLNLDECQTPQAQGVLSADEHNPVQLSVPETISRAPWRLLRIYEDPTGTTSTLYRPNTRLAVTIPTLDPHRGRLTGIVVQLLTLVVDPAGEVHDVPHTEWLVRLTF

SEQ ID NO: 244 - protein, 174 aa, Mycobacterium leprae
MSESYRKLTTSSIIVAKITFTGAMLDGSIALAGQASPATDSEWDQVARCESGGNWSINTGNGYLGGLQFSQGTWASHGGGEYAPSAQLATREQQIAVAERVLATQGSGAWPACGHGLSGPSLQEVLPAGMGAPWINGAPAPLAPPPPAEPAPPQPPADNFPPTPGDVPSPLARP

SEQ ID NO: 245 - protein, 74 aa, Mycobacterium leprae
MKSVNYYVVADIAKSKAHKSRYVDNGWPTTDPDHHAVSELVTDCAGALSPFGDLVFPVPADDLPYVHPVTVVNR

SEQ ID NO: 246 - protein, 753 aa, Mycobacterium leprae
MTDNTPDIPLGSWLADLSDERLIQLLELRPDLAQPPPGSIAALAARAQARQSIKAATDELNFLQFAVIDALLVLQADSTPVPTTKLKALIGDRAPQADVVSALDNLRQRALAWGETTVRIAAAAAAALPWHPGQVTLEDISSTGEQIAELIARLSQTQRDVLQKLLEGSPLGRTRDAAPGAPPDRPVPQLLAMGLLRRIDADTVILPRRVGQVLRGEQSGPTQLTQPYPVVSVTTPNDADAEAAGAVIEALHELDVLLETLGSAPVYELRNGGLGVREFKRLAKATGINEPRLGLLLEVTAAAGLIASGIPDPEPATGDSPYWAPTVATDRFTAMPPAERWHLLASTWLDLQCRPALIGSRGPDAKSYGALSNSLYSTAAPLDRRLLLGMLAELPAGVGVEAAEASAALIWRRPRWARRLQPGPVADMLAEGHTMGLVGRGAISTPGRALLDEAIASADPAIAVAAMTRALPEPIDHFLVQADLTVVVPGPLQRNLAKELGTVATVESAGTAMVYRISEQSIRHALDIGKTRDWMHALFTNHSKTPVPQRLTYLINDVARRHGQLRIGMAASFVRCEDPALLTQTVAAAEELQLRALAPTVAVSPAPIAEVLVTLQSAGFAPAAEDSSGSIVDVRPRRARLPTPQHRRPYRPLQRPNLETLNAVIAVLRKVAATPFGGIRVDPTVTMSLLQRATKEKTTLVIGYLDAAGIATQRMVSPIAIRGGQLVAFDPGTGRLRDFVIHRITSVVSSDSQ

SEQ ID NO: 247 - protein, 311 aa, Mycobacterium leprae
MVLNWRFALSADEQRLVREIISAATEFDEVSPVGEQVLRELGYDRTEHLLVTDSRPYAPIIGYLNLSSPRDAGVAMAELVVHPRERRRGVGAAMVRAALAKTGGRNRFWAHGTLASARATASVLGLVPVRELVQMQRSLRTIPDPMVPDQLGVWVRTYVGTVDDAELLRVNNAAFAGHPEQGGWTATQLAERRSEPWFDPAGLFLAFGDSSSNQPGKLLGFHWTKVHAAHPGLGEVYVLGVDPSAQGRGLGQMLTSIGIASLAQRLVGPSAEPTVMLYVESDNVAAARTYERLGFTTYSVDTAYALARIDD

SEQ ID NO: 248 - protein, 283 aa, Mycobacterium leprae
MVKDATCIKVRHNMRMRKVLTSVIATVVTMAVLVVGVLGIDYGTSIYAEYLLSVNVRNAANLGSDPFVAILAFPFIPQAMRDHYTELEIKANAVDHAMVGKASLEATMYSIDLTYASWLIKPDAKLPVDRLESRIIIDSMHLGQYLGISDLMVEAPHRETNNATGGTTESGISSGHGLVLSGTPKSANFDHRVSVLVDLSIAPEDQATLVFTPTGIATGPDTANQPVPDDKRNPVLRAFSARMSDQRLPFGVAPTSEGARGSDVIIEGITQGVTITLDGFKQS

SEQ ID NO: 249 - protein, 100 aa, Mycobacterium leprae
MCSEPKQRLALPANVNLEKETVITGRVVDRKGQAVGGAFVRLLDSSNEFTAEVVTSATGDFRFFAAPGSWTLRALSSVGNGDAMMSPSGTGIHKVDVKIT

SEQ ID NO: 250 - protein, 228 aa, Mycobacterium leprae
VTSDEVRDGAGSPADSSKGNKCTAAGMFQAAKRSTVSAARNIPAFDDLPVPSDTANLREGANLNSTLLALLPLVGVWRGEGEGRGPNGDYHFGQQIVVSHDGGNYLNWEARSWRLNDAGEYQETSLRETGFWRFVSDPYDPTESQAIELLLAHSAGYVELFYGRPRNASSWELVTDALACSKSGVLVGGAKRLYGIVEGGDLAYVEERVDADGGLVPNLSARLYRFAG

SEQ ID NO: 251 - protein, 62 aa, Mycobacterium leprae
MGRGRAKAKQTKVARELKYSSPQTDFQRLQRELSSTGAADPGQLDGDDRVSEDSWDEDAWRR

SEQ ID NO: 252 - protein, 131 aa, Mycobacterium leprae
MAVCDRADPAKTRQAVLALADWLKDRTLPAPDRDAVATAVRLTVRTLATLAPGASVEVRIPPYVAVQCVSGPSHTRGTPPNVVETDSRTWLLVATGLMQLVEAVATGALRMSGSRAGDIEVWMPLINLRCT

SEQ ID NO: 253 - protein, 79 aa, Mycobacterium leprae
VARAVVHVMLRAEILDPQGQAIAGALGRLGHTGISDVRQGKRFELEIDDTVDDSELAMIAESLLANTVIEDWTITRESQ

SEQ ID NO: 254 - protein, 206 aa, Mycobacterium leprae
MNSRFLPYATSPGRLTIQLLSDIAVVMWTTFWVLVGIAVYNTISTIADTGAQVESGAHGIADNLASASHGMQLIPVLGNAVSKPLTLTSAAALDIADAGHSLNTTASWLAVLLALAVIALPILVAVVPWLVLRFWFFRHKWTVTTLAATPAGKQLLALRALTLRSPSKLAAVSADPVGGWRREDPGTIRGLAALELQSSGITLRVH

SEQ ID NO: 255 - protein, 71 aa, Mycobacterium leprae
MPNNIAFSRSYIGKRCYSEQEVGVFIDLAEQERTRHIEEDVEFRNRNAELRNQDGAPQPRSCADRARNCHV

SEQ ID NO: 256 - protein, 100 aa, Mycobacterium leprae
VNRFLTSIVSWLRAGYPEGIPATDTFAVLALLARRLTNDEVKLVARELIRRGEFDKIDIGVMISHLTDELPSPQDIERVRTRLNAKGWLLDNARDNGEPT

SEQ ID NO: 257 - protein, 96 aa, Mycobacterium leprae
LSPWFNYEATLKILLFSTLAGAALPGLFALGIRLQVNDAGDASTNNATPHRKPILVTLAWVIYALVLMVVILGVLYIVSRDFIAHHTHYPFLGIKP

SEQ ID NO: 258 - protein, 138 aa, Mycobacterium leprae
MEILASRMLLRPTDYQRSLSFYRDQIGLAIAREYGTGTVFFAGQSLLELAGYVIQGAPDHSRGAFPGALWLQVRDIAVTQADLEGRGVSITREPRREPWGLHEMHVTDPDEITLIFVEVPANHPLRRDTRSERPRTPD

SEQ ID NO: 259 - protein, 175 aa, Mycobacterium leprae
VILSKSLLRILIHGRSDEPPSTRARVIMRWGRIAVLIVTGLITLQSVLLVAGAWRNDLTIQHNMGVAQAEVLSAGPRRSTIEFVTPERVTYRPELGVLYLSELSTGMRIYVEYNKNDPNLVRVRHRNAGLAIIPAGSIAVVCWLAATVVLVALAVLDKRLDRHTESSAVPSQPTS

SEQ ID NO: 260 - protein, 112 aa, Mycobacterium leprae
MKGTGLAANVAMAAAATVLAAPALADDYDAPFNAQLHSYGIYGAQDYNAWLGKIACQRLAKGVDGDVNKSATFIQRNLPLYTTEGQSLQFLGAAINHYCPNQIGILQRAGAR

SEQ ID NO: 261 - protein, 256 aa, Mycobacterium leprae
VTADLLAPLMELPGVATASDRARDALGRAHRHRANLRGWPVTAAEAALRAARASSVLDGGPVRLDHLPGASPQAGGVSDPVFGGALRVAQALEGGAGPLVGVWQRAPLQALARLHVLAAADQVGDEWLGRPRMDAEVGLRLGLLVDVVSGRTFAAAPVVAAVVHGELLTLQPFGSADGVVARAVSRLVTIATGLDPHGLGVPEVSWMRRAAVYRDAACGFAGGTPKGVAAWLVLCCRALHAGAQEALSIAESLPSR

SEQ ID NO: 262 - protein, 234 aa, Mycobacterium leprae
LVLRRGHWCILVALVAVLLAVVSMPAKTVFADGRLPMGGGAGIVINGDTMCTLTTIGTDSAAELIGFTSAHCGGPGAQVAAEGAENRGPMGTMIAGNDNLDYAVIKFDPAKVMPVAAYNGFVISGIGQDPAFGQIACKQGRTTGNSCGVAWGMGETSGTLVMQVCGRPGDSGAPVTVNNLLVGMIHGAFTDNLPVCITKFIPLHTPAVVMSMNAILADVNKNNRPGAGFVPQPV

SEQ ID NO: 263 - protein, 181 aa, Mycobacterium leprae
MSKGDRKNGVPSTLTTIPLVDPHAEPTEPSIGDLIKDATTQVSTLVRAEVELARAEIIRDVKKGLTGSVFFIAALVVLFYSTFFFFLFLAELLDTWLWRWVALLIVFAIMVMVTAALALLGYVKIRRIRGPHQTIESVKETRTALTPGHDKAQARPRKLTGSGTNPENNPDRRTPADPSGW

SEQ ID NO: 264 - protein, 381 aa, Mycobacterium leprae
MTAPTSHRPPTLDMAAILADTSNRVVVCCGAGGVGKTTTAAAMALQAAEYGRTVVVLTIDPAKRLAQALGVNDLGNTPQRVPLAPEVPGELHAMMLDMRRTFDEMVVQYSGPERAQAILNSEFYQTVATSLAGTQEYMAMEKLGQLLSQDRWDLVVVDTPPSRNALDFLDAPKRLGNFMNSRLGRLLLTPGRGIGRLVTGAMGLAMRALSTVLGSQMLADAATFVQSLDATFGGFRGKADRTYALLKQRGTQFVVVSAAEPDALREASFFVDRLSQENMPLAGLMLNRTHPTLCALPVEQAIDASKTLQDEITNSAAASLATAVLRIHADRGQTAKREARLLSRFTGANPHVPVIGIPLLPFDVSDLEALRAIADRLTASH

SEQ ID NO: 265 - protein, 81 aa, Mycobacterium leprae
LCRATDPDELFVRGAAQRKAAVICRHCPVMQECRADALDNKVEFGVWGGMTERQRRALLKQHPEVVSWADFFDTRKHRNVS

SEQ ID NO: 266 - protein, 215 aa, Mycobacterium leprae
VSWVIRISAVVMSVGLGLGVPVASARPSEPGVVSYAVLGKGSVGNIIGRPMGWESLLTEPLQAYSVDLPMCNNWADIGLPEVYHDVDLASFNGAITQTSANDQTHFVKQAVGVFATNDAAVRAFHRVVDRTVGCSGQTTAMHLDNGTTQVWSFVGGTPTYADANWTKQEAGTDRRCFVQTRLRENVLLQTKVCQPGNAGPAVNVLAGAMQNALGQ

SEQ ID NO: 267 - protein, 116 aa, Mycobacterium leprae
MQPGGDMSALLAQAQQMQQKLLETQQQLANAQVHGQGGGGLVEVVVKGSGEVVSVAIDPKVVDPGDIETLQDLIVGAMADASKQVTKLAQERLGALTSAMRPTAPPPTPPTYMAGT

SEQ ID NO: 268 - protein, 145 aa, Mycobacterium leprae
MGPVSAVSTILVNVEPVATLAAVADYQKMRPKILSPQYNEYQVVQGGQGPGTVVKWKLQVTRSRVRDVQVNVDVAGHTVIEKDANSSMVTSWTVAPAGPGSSVTMKTAWTGAGGVKGFFEKTFAPLGLKKIQAEVLANLKNELER

SEQ ID NO: 269 - protein, 250 aa, Mycobacterium leprae
MGYKVATLWHASFSIGAGVLYFYFVLPRWPELIGETTHTLGTTLRIVTGVLFGLAALPVVFTLLRSQTSELGIPQLALSIRTWSIVAHVLSGVLIVSTAIGEIWLSSDTAVQCLFGIYGAAAASAVLGFVAFYLSFVAALPPPSPKPVKLKKANQRRIRRRKGRKDNEAEDEEADAGEHNEAETPAQAEEVTSENPQPAPESGAQKEPDELLANKTEETDEPRRGLHNRRPTGKVSHQRRRARSGIAVEN

SEQ ID NO: 270 - protein, 113 aa, Mycobacterium leprae
MAFMTSNPSGPPSQPAPAVGLTPGERAVPVTRAGALWSALFAGFLILILLLIFIAQNTTSTPFTFFGWHWSLPLGVAIMLSAVGGGLLAVAVGTARILQLRRTVKKRYVAAHR

SEQ ID NO: 271 - protein, 154 aa, Mycobacterium leprae
MSKRQRGKGISIFKLLSRIWIPLVILVVLVVGGFVVYRVHSYFASEKRESYADSNLGSSKPFNPKQIVYEVFGPPGTVADISYFDANSDPQRIDGAQLPWSLLMTTTLAAVMGNLVAQGNTDSIGCRIIVDGVVKAERVSNEVNAYTYCLVKSA

SEQ ID NO: 272 - protein, 153 aa, Mycobacterium leprae
MSRLSTSLCKGAVFLVFGIIPVAFPTTAVADGSTEDFPIPRRQIATTCDAEQYLAAVRDTSPIYYQRYMIDMHNKPTDIQQAAVNRIHWFYSLSPTDRRQYSEDTATNVYYEQMATHWGNWAKIFFNNKGVVAKATEVCNQYQAGDMSVWNWP

SEQ ID NO: 273 - protein, 101 aa, Mycobacterium leprae
VAAGDNRLIGNDTPEIAVGAIGGVATGYVLWLVVMSIGYNITTVSQWSLIVLILSMVSVFCSGMCGWWLRQRRKHAWGAFTFGLPVFPVVLTLAVLAKIYL

SEQ ID NO: 274 - protein, 101 aa, Mycobacterium leprae
VSHIFLTLIADGELQYHGPDFGKASPMGLLVIVLLLVATLLLLWSMNRQLKKIPASFDSEHPELDQAADEGTELGGYLDEEPSDTDRNGPSLPPEPGADSG

SEQ ID NO: 275 - protein, 144 aa, Mycobacterium leprae
MNQAFTPLTETRYGRSRLPGRSRHRGVIALTVLAVAASTGIAVIGYQRLGTSDVAGSLASYRVLDDETVSVTISVMRSDPSRPVDCIVRVRAKDGSETGRREVLVAPAEATTVQVVTTVKSARPPVMADIYGCGTDVPGYLRPA

SEQ ID NO: 276 - protein, 111 aa, Mycobacterium leprae
VSKGPNSICAADHNRDHLVVNVLLYAAARLLLVILLGSVIYGVARLLGVTQLPIVVAALFALIIAMPLGIWLFSPLRRRATAALAVVGERRRSEREQLRARLRGEPLPDEE

SEQ ID NO: 277 - protein, 542 aa, Mycobacterium leprae
LMQVLMRLLAWVRNTWRALTSMGTALVLLFLLALGAIPGALLPQRDLNVGKVDDYVAAHPVIGSWLDQLQAFNVFSSVWFTAIYTLLFVSLVGCLTPRMIEHARSLRAMPVIAPRNLARLPKHASFQVIGDDKTLAGTIAGRLRGWRTVIRTQDGVVPETVVSAEKGYLREFGNLVFHFSLLGLLVAVAVDKLFGYEGNVVVIADGGPGFCSASPAAFDAFRAGNTVDGTSLHPICIRVNDFAAHYLPSGQAMSFTADIDYQDGHDLTVNSWRPYRLEVNHPLRVAGNRVYLQGHGYAPTFTVTFPDGQTRTSTVQWRPENQQTLLSSGVVRIDPPAGSYPNMSERRQHEIAIQGLLAPTEQLDGTLLLSRFPALNAPAVAIDIYRGDTGLDSGRPQSLFTLDPRLINQGRLTKEKRVNLQAGEQVRLGQGPGAGTVVRFDGAVPFVNLQVSHDPGQAWVFVFAIAMMVGLVVSLMVRRRRVWVRLTPAAGTVNVELGGLARTDNSGWGDEFERLTERLLAGLVAADRTLAAARRSSQMDVK

SEQ ID NO: 278 - protein, 166 aa, Mycobacterium leprae
MTVPLEAEGLIGKHYRQLDHFQVGREKIREFAIAVKDDHPTHYNETAAFEAGYPALVAPLTFLAIAGRRVQLEIFTKFNIPINVARVFHRDQKFRFYRTILAQDKLYFDTYLDSVIESHGTVIAEVRSEVTDTEGKAVVTSIVTMLGELARQDATAEETVAAIASI

SEQ ID NO: 279 - protein, 33 aa, Mycobacterium leprae
MGSVIKKRRKRMSKKKHRKLLRRTRVQRRKLGK

SEQ ID NO: 280 - protein, 280 aa, Mycobacterium leprae
LRPVIKVGLSTASVYPLRAEAAFEYAAKLGYDGVELMVWGESVSQDIDAVKGLSRRYRVPVLSVHAPCLLISQRVWGANPVPKLERSVRAAEQLGAQTVVVHPPFRWQRRYAEGFSDQVAELEAASDVMIAVENMFPFRADRFFGADQSRERMRKRGGGPGPAISVFAPSFDPLAGNHAHYTLDLSHTATAGSDSLEMVRRMGSGLVHLHLCDGSGLPADEHLVPGRGTQPTAAVCQLLAGADFAGHVVLEVSTSSVRSATERETMLTESLQFARTYLLR

SEQ ID NO: 281 - protein, 355 aa, Mycobacterium leprae
MTGPHNDTESPHARPISVAELLARNGTIGAPAVSRRRRRRTDSDAVTVAELTCDIPIIHDDHADEQHLAATHAHRANIGVRVVEPAAQSPLEPVCEGIVAEPPVDDHGHVPPGCWSAPEPRWPKSPPLTHLRTGLQRSACSRPLPHLGDVRHPVAPDSIAQKQSDAEGMSPDPVEPFADIPVDVMGSEVRAAELVAEESAYARYNLQMSAGALFSGHTLTNELAERRGDEHAAGGLLAVGIDLDEDHLDLHTDLAGITSPARGWQSRFEALWRGSLIVLQSILAVVFGAGLFVAFDQLWRWNSIVALVLSVLVILGLVVGVRVVRRTEDIASTLIAVVVGALITLGPLALSLQSG

SEQ ID NO: 282 - protein, 277 aa, Mycobacterium leprae
VSSCPESGSTFEYVANSHLEPVHPGEEVDLDFTREWVEFYDPDNSEQLIAADLTWLLSRWTCVFGTPACRGTVAGRPDDGCCSHGAFLSDDADRTRLDDAVKKLSHDDWQFREKGLGRKGYLELDEHDGQSQFRTRKHKNACIFLNRPGFPIGAGCALHSKALKLGVPPRTMKPDICWQLPIRHSQEWVTRPDGTEILKTTVTEYDRRSWGSGGADLHWYCTGDPASHVDSKQLWESLADELTELLGAKAYAKLAAICKRRNRLGIIAVHPATQEAK

SEQ ID NO: 283 - protein, 184 aa, Mycobacterium leprae
MSTAWDTVWHACSVIEHALQASHLTYSEFSGVPDGLLRLVVELPGERRLKTNAILSIGEHSVHVEAFVCRKPDENHEGVYRFLLKRNRRLFCVSYTLDNVGDIYLVGRMSLASVDTDEIDRVLGQVLEAVESDFNTLLELGFRSSIQKEWDWRISRGESLNNLQAFAHLIDDEGDGDASIYARP

SEQ ID NO: 284 - protein, 441 aa, Mycobacterium leprae
VIASTPRQNRESINRRVALTALGVGVFAPSVFVACAGSAIKPSEKKTTPAPHLTFQPATATDDVIPVAPISVQIADGWFQRVTLTNPVGKVVAGVFNQDRTVYTITEPLGYDTTYTWNGSAVGHDGKAVPVTGKFSTVTPVKKVNGGFQLADGQTVGVAAPIIIQFDAPISDKSAVEKALTVTTTPPVEGSWAWLPDEAKGARIHYRPREYYPAGTTVNVDAKLYGLPFGDGAYGLQDMSLNIQIGRRQVVKAEVSSHRIQVVTDAGVIMDFPCSYGEADQARNVTRNGIHVVTEKYSDFYMSNPAAGYSNVYERWAVRISNNGEFIHANPASVGAQGNTNVTNGCINLSTGDAEQFYRSAIYGDPVEVTGSSIQLSYSDGDIWDWAVDWDTWVGMSALLSFPTVHQPATQIPVTAPVTPPGAPILSGTPTSGSGTARPGG

SEQ ID NO: 285 - protein, 245 aa, Mycobacterium leprae
LLRDPLAIVLILIIVVALVISGLIGAELFARHTANSKVARVVTCEIKDQATAKFGVTPLLLWQFATQHFTNISVETAGNQIRDAKGMKIAIDIQNVQIRDTPTSRGTIGVLDAIITWSSDGIRQSVQNSIPVLGGVVTTSVTTHPTNGTIELKGMLNDIVAKPVVSNGGLQLQIVSFNTLGFSLPKETVQFTLDDFTTNLTKNYPLGIHADNVEVTSTGVTSHFSARNTNIPNSTGGQDPCFANL

SEQ ID NO: 286 - protein, 123 aa, Mycobacterium leprae
MSSPLSPLYVLPFVDHTKWTRWRSLISLQAYSNLFGRTSAMQPDVAAGDEAWGDVLTLSPDADTADMHAQFICHGQFAEFVQPSNTSSNLEPWRPVVDDSEIFAAGCHPGISEGIQQADEGPR

SEQ ID NO: 287 - protein, 95 aa, Mycobacterium leprae
MSHLVGTVMLVLQLAVLVTAVYAFVHAALQRPDAYTAAEKLTKPVWLVILGAAVSLTSILGFVFGVLGIVIAACAAGVYLVDVRPKLLDIQGKSR

SEQ ID NO: 288 - protein, 188 aa, Mycobacterium leprae
MAENPNVDDLRAPLLAALGAADLALTTVNELVGNMRERAEETRIDTRSRVEESRARVAKLQEVLPEHLSELREKFTADELRKAAEGYLEAATNRYNELVERGEAALERLRSRPVFEDASARAEGYVDQAVELTQEALGTVASQTRAVGGRAAKLVGIELPKKAAAPARKAPAKKAPAKKAPAKKVTQK

SEQ ID NO: 289 - protein, 264 aa, Mycobacterium leprae
VSLDKIMMPVPEGHPDVFDREWPLRVGDIDRTGRLRLDAGVRHIQDIGQDQLREMGFEETHPLWIVRRTMVDLIRPVEFQEMLRLRRWCSGTSNRWCEMRVRIDGRKGGLIESEAFWININRETQMPARIADDFLAGLHRTTSVDRLRWRGYLQPGSRDDASEIHEFPVRVTDIDLFDHMNNSVYWSVIEDYLVSHSELLKGPLRTTIEHEAPVALGDKLEIVLHVHPAGSTDQFGPGLVDRSVITLTYTVGDETKAIAAIFAL

SEQ ID NO: 290 - protein, 188 aa, Mycobacterium leprae
MSGGTGTGPVGRIPPGSLRQLGPINWVIAKLAASLLRTSEMHLFTILGQRQLLFWAWLIYGGRLLRGKLPRVDTELVILRVAHLRTCEYELQHHRRMARKRGLDTKIQAMIFAWPDVPTGAGLSVRQQALLAATDEFVKDRKITSSSWQQLETHLDRRRLIEFCMLISQYDGLAATISSLDIPLDNSC

SEQ ID NO: 291 - protein, 159 aa, Mycobacterium leprae
MPDGFGVAVVREEGQWRCSAMASKSLTSLTAAETELRELRSVGAVFGLLDVDDEFFIILRPAPSGTRLLLSDATAALDYDIAAEILDSLDAEIDPEDLEDAYPFEEGDLGLLSDVGLPEATLGVILDQTDLYADEQLGHIAREMGFAEQLSAVINRLGR

SEQ ID NO: 292 - protein, 286 aa, Mycobacterium leprae
MVPLWFTLSALCFVGAVVLLYVDIDRRRGRSRRRKSWARSHGFDYERESTEILQRWKRGVMSTVGDISAHNVVLGQIRGEAVYIFDLEEVATVIALHRKVGTNIVVDLRLKGLKEPRESDIWLLGAIGPRMVYSTNLDAARRACDRRMVTFAHTAPDCAEVMWNEQNWTLVSMPIGSTRVQWDEGLRTVRQFNDLLRVLPPLPADTSQEAGASARNAAPSRPLASVGRAELPPDRGVESDVAGLLGSGVQAGRSAEPISRDEGRWDGIRRPPSVERNGHQTTNYQY

SEQ ID NO: 293 - protein, 333 aa, Mycobacterium leprae
VTGPNSPNKTLQRFGISGTDLGIPWDNGDPTNHQVLMAFGDSFGYCSVKGQQRRYNILFRSSNQDLSHGIRIADGVPNDKYSGSPVWTTGLAKQVVNTIHRAPHETGIIPTTAISIGKTQYMNYMSIKKWGRDGEWTTNYSAIARSIDNGQSWGTYPGTIRTASPDAIPGTHFVPGNQNFQMGAFMRGNDGYLYSFGTPSGRSGAAYLARVPQNLVPDLSKYQYWNGNWVPNNPGAATPLFSGPVGEMSAQYNDYLKQYIILYSNGDSNDVVARTAPAPQGPWSPEQPLVSSFQMPGGIYAPMIHPWSSGRDLYFNLSLWSAYDVVLMHTVLP

SEQ ID NO: 294 - protein, 130 aa, Mycobacterium leprae
VGEYSAFGFDPDDFDRLIKEGSEGLRDAFERISRFVGGPGVRTAWSAIFEDLSRRARPAQETADEAGDGVWAIYTVTGDGAARVEQVYATELDALRANKNNVDPKRKVRFLPYGIAVSVLDSHQESTQQL

SEQ ID NO: 295 - protein, 218 aa, Mycobacterium leprae
MCRLIALLSAVVCAAWATLILAPIGAAAGAAWFANKVGNATQVVSVVSTGGSNAKMDIYQRTGTGWQPLKTGIPTYVGSAGLVAQAKSGYPATPMGVYSLDSAFGTAPNPGSQLPYTQVGPNHWWSGDDHSPTFNTMQVCQKSHCRFNTAESENLQIPSYKHAVVMGVNKAKVPGSGSAFFLHTTGGGPTEGCVAIDDVTLVQILRWLRPGAVIAITK

SEQ ID NO: 296 - protein, 339 aa, Mycobacterium leprae
VSAHRSRPAAMWPGSSRITLALLAVMPALMAYPWWFTRSYWLLGIVALVVVVLFGWWRGLYLTTILRRRLAMMWRRGRPVSASGSATRTTVLLRLGPPVGGSDVIPLPLITRYLNCYGIRADSIRITSRNNESDGALCETWIGLTVSAAKNLAALQARSSRIPLQETAQVAARRLADHLREIGWEVSLAVPDGIPRLITAAGDETWRGMQQGSDYLTAYRVNVDDELPGTLDAVRLYPARETWTALEIACPDSSSNRNTIAAACAFLTDTAPQGAAPLAGLTPQHGNHRPALAVLDLFSAQRLDGHTDTDADLLTRLRWPAPAAGVSSCTATRSPAVSA

SEQ ID NO: 297 - protein, 485 aa, Mycobacterium leprae
MVYVFAEEFCEGPVTSGAVMPIVRVAILADSRLIEMALPTELPLREILPAVKRLVVPAASDNDSPLAANASLHLSLAPIGGAPFSLDASLDTVGVVDGDLLALQPVPVGPAAPGIVEDIADAAMIFSTARLQSWGPTHIRRGALAATTAVTFAATGLGVTYRAVTGALTGLLVVIVIAVLIALGGLVLRSRAARTGLVLSIAALVPIGAVFALAVPGIFGPAQVLLASAGVTAWSLIALIVPGPERVRIVAFFTATVVIGVAVMLEAGAALLWQLTPLTIGCGLILAALLVTVEAAQLSALWARFPLPVIPAPGDPTPSAPSFQVLEDLPRRVRISSAHQSGFIAAATLLSMLGSVAIALRPEAVSSVGWYLVAATAVAATLRARVWDSVACKAWLLAQPYLVASVLLGLYTATGRYVAASAALLVLVVVVLAWAVVALNPRIASSDSYSLPLRRLLGMVASGLDASLIPAMAYLVSLFSWVLNR

SEQ ID NO: 298 - protein, 289 aa, Mycobacterium leprae
MKVDPNAVELTVDHAWFIAEVIGAGSFPWVLAITTPYRDAGERSAFVERQVDELTRMGLLVAENSVDPTVADWIRVVCFPDRWLDLRYLRSTSAVGDSELLRGMVAQRAGVSDKTVVALRSAQLITFTAMDIDDPLRLVPILGAGLAQRPPARFDEFSMPMRVGVRADERLRSGTSLAEVADYLGIPKSAQPVVESVFSGPRSYVEIVAGCRRDGKHATTEVGMSIVDTTTGRVLVNPSRAFDGEWVSTFSPGTPFAIAVGIEQLTATLPEGQWFPGQRLCRDFSGQTS

SEQ ID NO: 299 - protein, 96 aa, Mycobacterium leprae
MTQIMYNYPAMLDHAGNMSACAGALQGVGIDIAAEQAALQACWGGDTGISYQAWQVQWNQATEEMVRAYHAMANTHQNNTLAMLTRDQAEAAKWGG

SEQ ID NO: 300 - protein, 98 aa, Mycobacterium leprae
VSLLDVHIPQLVASESAFAAKAALMRSQINQAECEAISAQAFHQGESSAAFQSAHAQFVTAAEKINALLDIAQQHLGEAAETYVATDATAASTYTTGL

SEQ ID NO: 301 - protein, 102 aa, Mycobacterium leprae
MTLRVVPEKLAATSEAMKALTARLEAAHAAAFPCLVAVVPPAADPVSLQTAAGFSARGQEHALVAAQGVEELGRAGIGVGQSSTHYAISDALAASTYGIVES

SEQ ID NO: 302 - protein, 552 aa, Mycobacterium leprae
MTSNELPGEWSGERRSFFSRTPVNDNPDKVVYRRGFVTRHQVTGWRFVMRRIASGIALHDTRMLVDPLRTQSRSVLVGALLVITGLIGCFVFSFIRPNGAAGNNAVLADRSTAALYVRVGDELHPVLNLTSARLIVGRSVNPITVKSSELDRFPRGNLIGIPGAPERMVQNTTHDANWTVCDVVSGEGGHAAHSMGVTVIAGPPDSHGMRAAVLGSAHGVLVDAPSERGGSTWLLWDGKRSEIDLADHAVTDALGFGVGFAEVPAPRPIGAGLFNAIPEAPPLKAPVIPNAGATPSFGVRAPIGAVVVSFGLAALGKNPYDSVRYYAVLPDGLQPISPVLAAILRNINSYGLQQPPRLGADEVDKLPVSRMLDTERYPEQQISLIDAGYAPVSCAYWSKPAGAATSFLSLMSGAALPVPDAARAVELVSAPSRGDSSTASRVVLTPGTGYFAQTVGVGSAAPATASLFWVSDTGVRYGIDTEADARSEATAGPGKIVEALGLKLPAVPIPWSILSLFAVGPTLSRADALLEHDGLAPDTRAGRTTTAYGEHR

SEQ ID NO: 303 - protein, 98 aa, Mycobacterium leprae
LYATTELAELHDLIGRMRRSVASFKARYGDSPAMRRIAIDADRILSDIELLDADISELDLARATVQQSNEKIAIPDTQYDSDFWRDVDDEGVGGHSRS

SEQ ID NO: 304 - protein, 300 aa, Mycobacterium leprae
LTFGFVLRRLRRHFSVKENTVNQPSGLKNILRAIVGALPLLPRTDQLPSRTVTIEELPIDHTNVSAYASVTGLRYGNHVPLTYPFALTFPAMMSLVTGFDFPFAAMGSVHTENHITQYRPIAVTDVVGVQVHAENLREHRKGLLVDLVTDVSVGNDTAWHQVTTFLHLQRTSLSDEPKPPSQKQPKLLPPSAVLQITPRQIRRYAAVGGDHNPIHTNPIVAKLFGFPTTIAHGMFSAAAVLANIEARLPDAVHYSARFVKPVVLPATTGLYVDESAGNWDLTLRNIAKGYPHLAGTVQGV

SEQ ID NO: 305 - protein, 57 aa, Mycobacterium leprae
MSRIVAPAAASVVVGLLLGAATIFGMTLMVQQDTKPPLPGGDPQSSVLNRVEYGNRT

SEQ ID NO: 306 - protein, 1405 aa, Mycobacterium leprae
VAAMSRWWLVLVGVVAVALTFAQSPGQISPDTKLDLTTNPLRFLARATNLWNSDLPFGQVQNQAYGYLFPHGTFFLIGQLLGSPGWITQRLWWALLLTAGFWGLLRVAETLSIGSPTSRAIGAVAFALSPRVLTTLGSISSETLPMMLSPWVLLPTILALQGAPGRSVRTRAAQAGLAVALMGAVNAIATLAGCLPAVIWWACHRPNRLWWRYTGWWLLALCLATLWWVVALVLLHGVSPPFLDFIESSGVTTQWSSLVEMLRGTDSWTPFVAQTATAGTPLVTESVAILGTCLVAAAGLAGLASTGMPARGRLVTMLVIGVVLLSAGYSGGLGSPLAQAVQAFLDSSGAALRNVHKLESVIRTPFALGIAGLLGRIPLPGSAPVLVWLSSFAHPERDKRVAATVAVLTALLVSTSSAWTGRLTPPGTFSAIPQYWHDTSDWLSEHNTGIPTPGRVLVVPGAPFATQVWGTSHDEPLQVLGNSPWGVRDSIPLTPPQAIRALDSVQRLFASGRPSVGLADTLARQGISYVVLRNDLDPDTSRSARPILVHRAIAGSPQLEKVAQFGAPVGTNMLKGFVADSELRPWYPAVEIYRVAVSDGTNPGKPYFADTDQLPRIDGGPEVLLRLDERRRLLGQPALGPALMTADAQFAGLPLPSRAEVTITDTPVARETDYGRVDQHSSAIRAVNDARHTFNRVPDYPVPGAEMVFGGWSGGRITASSSSSDATSMPDVAPATSPAAAIDGDPATSWVSNALQPAVGQWLQVDFDHPVNNAVITVTPSATAVGAQVRRIEIETVNGTTNLRVDEAGKPLAVALPYGETPWVRITAAATDDGSSGVQFGITDLTITQYDASGFAHPVNLRHTALVPGSPPGWAVAGWDLGSELLGRPGCAPAPDNVRCAASMTLAPEEPVNFSRTLTVPYPISVTAMLWVRPRQGPKLADLIAEPKTTRAYGEADTVDILGSAYAATDGNPATSWTAPQRVVQHKTPPTLTLVLPRPTEVNGLRLAPSRSALPARPTLVAVNLGNGPQVRELQAGEPQALSLKPRITDTVTISLLDWHDVIDRNALGFDQLKPPGLAEVTVLGTDGNPIAPANASRNRIREVTVDCDHGPIIAVAGRFVHTSIRTTAAALLDGEPVAAVPCERAPIVLPAGQQELLISPGAAFIVDGAQLSTQDGTELPSARTISADTGKWGPSRREVRAPGSATSQVLVMPDSINPGWVAHTSTGVRLMPVAVNGWQQGWLVPAGNPGTITLTFTANSLYRPGLAAGLALLPLLALLALWGRRNERAADAAAQPWTPGAWSAVAVLSAGAVIAGAAGVVVVGAALSLRYALRHQQRWRNGLTVGLSAGGLVLAGAALSRQPWRSVDGYSGHSANVQLLALISLAALAASVVSPRCGSTGVAT

SEQ ID NO: 307 - protein, 427 aa, Mycobacterium leprae
VNRAVILRFTACGIIGLGAAFLIAALLLATYTSSRITKIPLDIDATLVSEGNGTALDSSSLSSEHIIVNQNVPLVSQQQITVESPANVDVVTFQVGVSIRRTDKQKDTGLLLAVVDTVTLNRKTAMAVSDDTHTGGSIQKPRGFTDENPPTAIPLRHDGLSYRFPFHTEKKTYPYFDPVAQKTFDVNYQNQEDINGLTTYRFTQNVGYDADGKLVAPITYPSLYASDEDGKITTTAAIWGLSGDPSEQITMTRYYAAQRTFWVDPVSGTIVKETEHVNHYFARDTLKPEVTLADYKVTSTEETIESQVNSARDERDRLALWSRVLPITFTAVGLITLLSGGFLASFSLRTESALTESGLDRANRDAFGHCRTEEPVPGAEAETEKLPTQRPELRDSSILSVSAHRRRSSESSPPNSGPADPGHPERG

SEQ ID NO: 308 - protein, 600 aa, Mycobacterium leprae
VSRELYHRSMSWSRPSYALGMALLVVGPLMRPGYLLLRDAVSTPRSYLSDAALGLTSAPRSTPQDFAVAMASHLVDGGIVVKSALVLGLWLAGWGAARLVVTALPSAGVAGQFVASTLAVWNPYVAERLLQGHWSLLVGYGCLPWVAEAMLMLRSSDNASRPGLLGFFALACWIALAGLTPTGLMLAATVALICVAVPVEGPGEPRPRWLCAAATLGSALGAALPWLTASAVGTSLTAHTVANTLGVTVFAPRAEPGLGTLASLASLGGIWNGEAVPTSRTTLFAVLSATVLLGVVVAGLPVAVRRPAVVPLLVLAAVAVATPAALATGPGIDMLKAVVNAVPGLGVLRDGQKWVALAVPGYSLAGAGAVVTLGRWLRPSRPLSPVVTALACCLALILALPDLAWGVWGKVQPVHYPSGWAAVAATINDRGEGPGWVAVLPAGTMRRFSWSGTAPVLDPLPRWVRDDVLTTGDLIISGVMVAGEGNHARAAQDLLLSGPNPSALTAAGVAWLVVESDTAGDMGASARTLAALQPTYRDDAIGLYRIGGSNAKTAPSPYRGLLIAAHLTWLVILVMAVVGMQITRHTHFRDVSSVALLSRR

SEQ ID NO: 309 - protein, 182 aa, Mycobacterium leprae
LPESQVAADDSGVTLNRSRLGRGWLTGIAVALLLAGCGIGTGGYCMLRYHQDSQAMARNDNAALKTALDCVAATQAPDTNTMAASEQKIIDCGTDAFHAQALLYTNMLVQAYQAANVHVQVSDMRAAVERHNNDGSIDVLVALRVKLSNDRAHNQETGYRLRVKMALAEGQYKISKLDQVTK

SEQ ID NO: 310 - protein, 325 aa, Mycobacterium leprae
VTVVVAKSQTAAVIPEPLSNRLAPWHLRLVALAVDVLPGLVAVSTMTLVVFTVPLRSAWWWLCMAVGGIVILSMLVNRLLLPTIIGWSLGRALCGISVIMRDGVAIGPWRLLLRDLTHLLDTAAVFAGWLWPLWDSRRRTFADILLRTEVRCVQAVERQRTIRWWASVALLTAAGVSLGGASVSWAVVYSHDRAIDQTRSEIAIQGPKMVAQMLTYNPKSLRDDFTHAQSLASDKYRRQLAAQQDVVKKGHPVINEYWPTAGAIQSATRDRATMLLFMQGRRGAAPGERYISATVRVSFAKGEHNHWLVDDLTVLTKPKTTGNGR

SEQ ID NO: 311 - protein, 184 aa, Mycobacterium leprae
MSPRRKFQAGEGLLLVSHTVASQRRWGLPLAATFAALVMVAAITASTLMSISHASRELAVAKDQQVLSYVKWFMTQFTTLDPYHANDYVARILAQATGDFAKQYNEKVNEILLQVAQAEPATGTVLDAGVERWNDDGSANVLVATEVTSKYPDEKQVLENTNRWTATATREGNQWKISNLLQVI

SEQ ID NO: 312 - protein, 184 aa, Mycobacterium leprae
VAAAEGGGSWRNRRAGQRTAIAVVVAAVLFVGSAAFAGAAVQPYLADRATVAVKLEVARTAANAITVLWTYTPENMDTLADRAATYLSGDFGAQYRKFVDAIVGPNKQAKITNSTEVTGVAVESLDASNAIAIVYTNTTSTSPLTKNIPALKYLSYRLFMKRSAVRWLVTRMTTITSLDLTPQL

SEQ ID NO: 313 - protein, 249 aa, Mycobacterium leprae
MTDNKMLARIAALLRQAEGTDNAHEADAFMATAQRLATAASIDLAVARSHVANRSTAQAPTQRTITIGTAGTRGLRTYVQLFVLIAAANDVRCDVASNSTFLYAYGFAEDIDATHALYASLVVQMVRESDAYLASGAYRPTPTITARLNFQLGFGMRVGQRLTEARDHIRSAVTEAWDRPTATAIALRDKEIELIDYYRSASKARGTWQAARASAGYSSAARNAGDQAGRRAWIDNSTELPGARAALGR

SEQ ID NO: 314 - protein, 168 aa, Mycobacterium leprae
MNLLDSVRDAQRSKVYAAEEFIRTLFDRAVEHGSPAVEFFGAQLSLPPEARFGSVAAVQRYVDDVLALQAVRQRWPRMLPLTVRARRAATAAHYENLDGAGVIAVPGNNADWAMRELVVLHEVAHHLCKDPPPHGPEFVATICALTELVMGPELGYVFRVVYAKEGVR

SEQ ID NO: 315 - protein, 224 aa, Mycobacterium leprae
VNWPKTPGTLAAMPDEEQTELPVHKEFAGIADYSDPGLSDGSVFSQYGIASTVLAVLSAAAVVFGVVIWRAHHDNSAERAYLTHVMQTAFDWTGVLINMNTSNVDASLQRLHAGTVGELNTDFDAAVQPYRKVVEKLQTQSRGQIEAVAIESVHHDLDTQPGVAHPVVTTKLLPPAARTDSVMLVATSVSENVGGKPTTVHWSLRLDVSDVDGKLMISHLESIR

SEQ ID NO: 316 - protein, 229 aa, Mycobacterium leprae
MRNRWRLLAFDVVAPLVAIAALVMIGVVLDWPRWWVSACSVLVLLIVEGVGVNFWLLRRDSVTIGTDDDAPGLRLAVVSVCTAALCAAVLIGYMHWTSPDRDFSLDSREVVQIATGMAEAMASFTPSAPTSSIDRAAAMIMPDQAGVFKEQYRKSSADLARRNVTAQASVLAAGVEAIGSSAASVAVILRVTQNTPGQPPSQAAPAVRVTLIKRGSDWLVTDVLSINAR

SEQ ID NO: 317 - protein, 170 aa, Mycobacterium leprae
VTLADDHRRPAAPPEQPAADQGRYDPDQPVEFWSTAAIRSALHAGSIEIWKLITAAVKHDPYGRTAHQVEEVLEGTRPYGICKALGEVLQRARTHLEINERAEVARHVRLLIDRSGLGHQEFASRIGVAPEGLASYLDGSTSPSAALMVRMRRVSDRFVKVKAARSANSD

SEQ ID NO: 318 - protein, 195 aa, Mycobacterium leprae
MLIWDAPNLDMGLDAIVDHHHRNALERPCFDALGRWLFTCNTEVAVGYPDSTIGLKGTMFTNIAQASADVVRLWVDTLRNVEFVIFVKPKIDEDSHMLGRIKGRYNEGLAVQVVVSAYSQALRQTLERTAHAVIDVQMIGFREHTSWALASAILEFADLEDIAGVFRESLPRISLDSLPAQGEWCAPFPGRWLRY

SEQ ID NO: 319 - protein, 339 aa, Mycobacterium leprae
VTANGHAGRREGGPYFDDLSIGQVFDWAPAVTLTSGMAAVHQAILGDRMRLALDAELSTTVIGTHAMLAHPGLVCDVAIGQSTLVTQRVKANLFYRGLTFHRFPVIGDTLYTSTEVVGLQANSAKPGRPPTGMAALRITTTDQHDRLVLDFYRCAMLPASAAWHPHDALNRNDDLANVGADAVASASDPTGQWDAAAFRERVPGPHFDAGITGAVLRSTGDIVSSAPDLARLTLNIASTHHDSRVRGLRLVYGGHTIGLALAQAGRMLPNLATVLNWRSCDHTGPVHEGDTLYSELHVESAEATEQGGVLGLRSLVYAVSAAGGSDHLVLDWRFTVLQF

SEQ ID NO: 320 - protein, 156 aa, Mycobacterium leprae
LGSVPGYASPMPVMSKTVEVRATAASIMAIVTDFEAYPQWNDGVKGVWVLARYDDGRPSQLRLDTEIQGTKCTYIQAVYYPATNQIQTIMQQGDLFTKQEQLFSAVEIGAASLLTVDIDVESSMPVPAPMVKALLNNVLDNLAENLKLRAEQLAAN

SEQ ID NO: 321 - protein, 123 aa, Mycobacterium leprae
LLTDGVLLPELLFGYLNKCCLLPQLFDTAINTSVGVTSPNESRAFNAADDLIGDGSVERAGLHRATSVPGESPEGLQRGHSPEPNDSPPWQRGSAQASQSGYRPSDPLTTTRQSNPAPGANVR

SEQ ID NO: 322 - protein, 310 aa, Mycobacterium leprae
MRTHDDTWDIKTSVGTTAVMVAAARAAETDRPDALIRDPYAKLLVTNTGAGALWEAMLDPSMVAKVEAIDAEAAAMVEHMRSYQAVRTNFFDTYFNNAVIDGIRQFVILASGLDSRAYRLDWPTGTTVYEIDQPKVLAYKSTTLAEHGVTPTADRREVPIDLRQDWPPALRSAGFDPSARTAWLAEGLLMYLPATAQDGLFTEIGGLSAVGSRIAVETSPLHGDEWREQMQLRFRRVSDALGFEQAVDVQELIYHDENRAVVADWLNRHGWRATAQSAPDEMRRVGRWGDGVPMADDKDAFAEFVTAHRL

SEQ ID NO: 323 - protein, 251 aa, Mycobacterium leprae
MYQAVRYLLVMAAIILMAVAESGSPSVAAIPALKPTPEVASVLPTNGAVVGVAHLVVVTFTAPVTDRSAAERSIRITSPNNMTGHFEWLDGDVVQWIPTKYWPAYTHVSVEVQALTTGFETGDALLGVASLSTHTFTVSRNGEVLRTMPASMGKPTRPTPIGKFTALSKERTVVMDSRTIGIPLNSPEGYLITAQYAVRVTWSGVYVHSAPWSVNSQGYTNVSHGCINLSPDDATWYFNTVNVGDPIEVVA

SEQ ID NO: 324 - protein, 564 aa, Mycobacterium leprae
VINAQTHSTTISPRPLAADRQSADNRDCPSRTDYLGAALADAIGGPVGCHALIGRSWLMTPLRVMFLIGLVFLALGWSTKAACLQTTGTGPGGQRVPNWDNQRAYYELCYSDIVPLYGTELLSQGKFPYKSSWIETDSSGTPRTRYDGRLAVRYMEYPVLTGIYQYVSMAVAKSYTALSEPVSLPAVAEVVMFFDVVAFGLALAWLATIWATAGLAGLRIWDAALVAASPLVIFQVFTNFDALAIAFATGGLLAWSRCRPISAGVLIGLGAAAKLYPLLFLVPLFVLGVRTGRLGGVACAAVTAATTWLLVNLPVLLLFPRGWSEFFRFNTRRGDDMDSLYNVVKSLTGWRGFDTKLGFCELPLVLNTVVTVLFALCCAAVAYIALTAAQRPRVVQLAFLLVAVFLLTNKVWSPQFSLWLVPLAVLALPHRRVLLAWMTIDALVWVPRMYYLYGNPSRSLPEQWFTATVLLRDIAVVALCALVIRQIYRPDEDPVRLGGRVDDPAGGPFDRAPYAPPSWLPDWLHPAGMRRVVTLAASSVTETELAAAATPSGPMHHPHAPSSI

SEQ ID NO: 325 - protein, 138 aa, Mycobacterium leprae
VVNYSLRRRFLLAEVYSGRTGVSEVCDANPYLLRAAKFHGKPSQVMCPICRKEQLTLVSWVFGNQLGAISGSARTAEELVLLATRYEEFAVYVVEVCRTCSWNYLVRSYVLGAARSAPPPRGTPVTRTACNGARMAIE

SEQ ID NO: 326 - protein, 797 aa, Mycobacterium leprae
VTASRLRLAGSLSIALVVDIVASFAVLLVAPTATPHAAADEPRATSFVRVRIDKVTPDVVTTSSEPVVTVSGVVTNIGDRPVRDLMVRLEHESAVISSAVLRTYLDDGADQFQTAADFVTVAEELQRGQEAGFTLVAPIRSTTKPSMAIDQPGIYPVLVNVNGTPDYGTPARLDNARFLLPVAGVPPAKSDAMDSAVAPDITKPVWITMLWPLADRPRLSPGAPGGTIPVRLVDDDLASSLAPGGRLDILLTAAETATGRDVDPDGAVSRALCLAVDPDLLVTVNAMTGGYIVSNSPDGPAQQPGTPTHPGTGQDAAVIWLNRLRALAHRMCVASLPYAQADLDALQRINDTELSTTATTSVGDIVDHILDVTSIRGVTMLPDSPLTNRVVDLLNDNNSTVAIAAAAFSAQDSTSGSLVDIDTEPRRLSPRVVVAPFDPAVGAALAAAGTDPIVPTYLDSSLNIRIVHDSDTARRQDALSSILWRALERDAAPRSQILVPPTSWHLQADDARVMLTTLSTVIRSGLAVARPLPTVIADALARTKLSDTVGSYTSARGRFNDDIIADIASQVGRLWGLTSALTADGRTGLTGVQYTAPLREDMLRALSQLEPPATRNGLAQQRLAVVSKTIKDLIGAVTIVNPGGSYTLATEHSPLPLALHNGLAVPIRVRLQVDAPPGMTVTDVSQIELPPGYLPLRVPIEVNFTQRVAVDVALQTPEGIQLGEPVRLLVHSNAYGKVLFEITLTAATILIVLAGRRLWHRFRIQTEGADSNRPDPLIVDAHPQHQYDDWVDEENRI

SEQ ID NO: 327 - protein, 102 aa, Mycobacterium leprae
MTLGVIPEGLEGASAVIEALTAHLATVHAEAAPFIMEVIPPGSGSVSVQNQVGFNVHGCQYVAMTAHGAEELGRWGVGVAESGVSYALRDAFAVASYLGGGL

SEQ ID NO: 328 - protein, 275 aa, Mycobacterium leprae
MAQKPVPNALILQLEPVVKDNMARHFANEELWFAHDYVPFDRGENFAFLGGRDWDPSQATLAKAVTDACEILLILKDNLAGYHRELVEHFILEGWWGRWLGRWTAEEHLHAIALREYLVVTREVDPVANEQVRVEHVMKGYRVNSYTQIETLVYMAFLERSYAFFCGSLAAQIKEPALFGLINQIVKDEVRHEEFFANLVAHCLECNRDETVAAIAARAAGLDVLGADIDAYHDKVENISAAGIFGSVELRQVISDRITAWGLINEPQLAQFVTS

SEQ ID NO: 329 - protein, 1111 aa, Mycobacterium leprae
VPHDGHEPPQRIIRLIAVGAGITGLLLCAVVPLLPVKQTTATIRWPQSATRDGWVTQITAPLVSGTPRALDISIPCSAMATLPDSVGLVVSTLPSGGVDTGKSGLFVRANKNAVVVAFRDSVAAVAPRPAVAAGNCSVLHIWANTRGAGANFVGIPGAAGILTAEKKPQVGGIFTDLKVPVQPGLSAHIDIDTRFITAPTAIKKIAVGVGAAAVLIAILALSALDRRNRNGHRLINWRVSMAWLAQWRVILATPPRAGGASRIADGGVLATLLLWHIIGATSSDDGYNLTVARVSSEAGYLANYYRYFGATEAPFDWYFTVLAKLASVSTAGVWMRIPATLAGIACWLIINHWVLRRLGPGTGGLSTNRVAVLTAGAMFLAAWLPFNNGLRPEPLIALGVLFTWVLVERAIALRRLASAATAAVVAILTATLAPQGLIAIAALLTGARAITQTIRRRRTTDGLLAPLLVLAASLSLITLVVFHSQTLATVGESARIKYKVGPTIACYQDFLRYYFLTVESNADGSMTRRFPVLVLLLCMFGVLVVLLRRSRVPGLASGPTWRLIGTTATSLLLLTFTPTKWAIQFGALAGLTGTFGAIAAFAFARISLHTRRNLTVYITALLFVLAWATAGINGWFGVSNYGVPWFDIQPVIAGHPVTSIFLTLSILTGLLAGGQHFRLDYAKHTEVKDTRRNRFLATTPLVVVATTMVLCEVGSLAKGAVARYPLYTTAKANLAALRSGLAPSVCAMADDVLTEPDPNAGMLQPVPGQIFGPTGPLGGMNPIGFKPEGVNDDLKSDPVVSKPGLVNSDASPNKPNVTFSDSAGTAGGKGPVGVNGSHVALPFGLDPDRTPVMGSYGENTLAASATSAWYQLPLHWKESIADRPLVVVSAAGAIWSYKEDGNFIYGQSLKLQWGVTRPDGIIQPLAQVMPIDIGPQPAWRNLRFPLTWAPPEANVARVVAYDPNLSPDQWLAFTPPRVPVLQTLQQLLGSQTPVLMDIATAANFPCQRPFSEHLGIAELPQYRILPDHKQTAASSNLWQSSEAGGPFLFLQALLRTSTISTYLRDDWYRDWGSVEQYYRLVPADQAPEAVVKQGMITVPGWIRRGPIRALP

SEQ ID NO: 330 - protein, 1083 aa, Mycobacterium leprae
MSVIYRAHRVAIANRTASRNVRVARWVAAIAGLIGFVSSVVTPLLPVVQTTATLNWPQNGQLNSVTAPLISLTPVDITATVPCAVVAALPPSGGVVLGTAPKQGKDANLNALFIDVNSQRVDVTDRNVVILSVPRNQVAGDAGAPGCSSIEVTSTHAGTFATFVGVTDSAGNPLRGGFPDPNLRPQIVGVFTDLTGGAPSGLRLSATIDTRFSSTPTTLKRFAMMLAIITTVGALVALWRLDQLDGRRMRRLIPARWSMFTLVDVAVIFGFLLWHVIGANSSDDGYQMQMARTADHSGYMANYFRWFGSPEDPFGWYYNLLALMIHVSDASMWIRLPDLICGVACWLLLSREVLPRLGPAIVGFKPALWAAGLVLLAAWMPFNNGLRPEGQIALGALITYVLIERAITYGRMTPVALATLTAAFTIGIQPTGLIAVAALLAGGRPMLYILVRRHRAVGAWPLVAPLLAAGTVVLTVVFAEQTLSTVLEATKVRTAIGPAQAWYTENLRYYYLILPTVDGSLSRRFGFLITALCLFTAVLITLRRKQIPGVARGPAWRLIGTILGTMFFLTFAPTKWVHHFGLFAALGAAVAALTTVLVSHEVLRWSRNRMAFLAALLFVMTLCFATTNGWWYVSSYGVPFNSAMPRIDGITFSTIFFILFAIVALYAYYLHFTNTGHGEGRLIRTLTVSFWAPIPFAAGLMTLVFIGSMVAGIVRQYPTYSNGWANIRALTGGCGLADDVLVEPDSNAGYMTALPSNYGPLGPLGGVNAIGFTANGVPEHTVAEAIRITPNQPGTDYDWEAPTKLKAPGINGSVVPLPYGLNPNKVPIAGTYTTGAQQQSRLTSAWYQLPKPDDRHPLVVVTAAGKITGNSVLHGHTYGQTVVLEYGDPGPNGGLVPAGRLVPDDLYGEQPKAWRNLRFARSQMPFDAVAVRVVAENLSLTPEDWIAVTPPRVPELRSLQEYVGSSQPVLLDWEVGLAFPCQQPMLHANGVTDIPKFRITPDYSAKKIDTDTWEDGANGGLLGITDLLLRAHVMSTYLARDWGRDWGSLRKFDPLVDTHPAQLDLDTATRSGWWSPGKIRIKP

SEQ ID NO: 331 - protein, 1070 aa, Mycobacterium leprae
VSGAGANYWIARLLAVIAGLLGALLAMATPFLPVNQNTAQLNWPQNSTFESVEAPLIGYVATGLNVTVPCAAAAGLTGPQSAGQTVLLSTVPKQAPKAVDRGLLIQRANDDLVLVVRNVPVVSAPMSQVLSPACQRLTFAAYFDKITAEFVGLTYGPNAEHPGVPLRGERSGYDFRPQIVGVFTDLSGPIPTGLNFSATIDTRYSSSPTLLKTIAMILGVVLTIVALVALHLLDTADGTQHRRLLPSRWWSIGCLDGLVITILAWWHFVGANTSDDGYILTMARVSEHAGYMANYYRWFGTPEAPFGWYYDLLALWAHVTTTSAWMRVPTLAMALTCWWLISREVIPRLGHAAKASRAAAWTAAGMFLAVWLPLDNGLRPEPIIALGILLTWCSVERAVATSRLLPVAVACIVGALTLFSGPTGIASIGALLVAVGPLLTILQRRSKQFGAVPLVAPILAASTVTAILIFRDQTFAGESQASLLKRAVGPSLKWFDEHIRYERLFMASPDGSVARRFAVLALLVALSVAVAMSLRKGRIPGLAAGPSRRIIGITVTSFLAMMFTPTKWTHHFGVFAGLAGSLGALAAVAVASAALRSRRNRTVFAAVVLFVVALSFASVNGWWYVSNFGVPWSNSFPKLRWSLTTALLELTVIVLLLAAWFHFVATTNGSAKTRFGVRIDRIVQSPIAIATWSLVIFEVASLTMAMIGQYPAWTVGKSNLQALTGQTCGLAEEVLVEQDPNAGMLLPVSTPVADALGSSLAEAFTANGIPADVSADPVMEPPGDRSFVKENGMTTGGEAGNEGGTNATPGINGSRAQLPYNLDPARTPVLGSWQSGIQVVARLRSGWYRLPARDKAGPLLVVSAAGRFDHHEVKLQWATDSGAASGQPGGAFQFSDVGASPAWRNLRLPLSAIPSMATQIRLVADDEDLAPQHWIALTPPRIPQLRTLQDVVGYQDPVFLDWLVGLAFPCQRPFDHQYGVDETPKWRILPDRFGAEANSPVMDNNGGGPLGVTELLLKATTVASYLKDDWSRDWGALQRLTPYYPNAQPARLSLGTTTRSGLWNPAPLRH

SEQ ID NO: 332 - protein, 404 aa, Mycobacterium leprae
VGTATRRVQPKAWRALLTLLVISVVMPGVACNRGGGNVPVNVIGDKGTPFADLLVPKLTASVTDGAVGVNVDMPVTVTVADGVLAAVTMINDNGRMINGQFSPDGLRWSTTEPLGFNRCYTLSAKALGLGGVVNRQMTFQTSSPAHLTMPYVNPGNGEIVGIGEPVAIRFDENIANRLAAQKAITITANPPVEGAFYWLNNREVRWRPEHFWKSGTAVDVAVNTYGVDLGEGMFGEDNVKTHFTIGDEVFATADDATKMLTVRVNGEVVKIMPTSMGKDSTPTANGIYIVGARFKHIIMDSSTYGVPVNSPNGYRADVDWATQLSYSGVFLHSAPWSVGAQGHTNTSHGCLNVSPSNAQWFYDHVKRGDIVEVVNTVGDTLPGAEGLGDWNIPWEQWKAGNANI

SEQ ID NO: 333 - protein, 233 aa, Mycobacterium leprae
MNDRKWVTSSVMLVTLSACLALGLSGCSSTKPDAQEQSSSSSPASSDPALTAEIKQSLETTKALSSVHVVVQTTGKVDALLGISNADVDVQANPLAVKGTCTYNDQPGVPFRVLGDNISVKLFDDWSNLGSISDLSTSHVLDPNTGITQVLSGVINLQAQGTEVVDRIPTNKITGTVPTSSVKMLDPKAKGSKLATVWIAQDGSHHLVRASIDLGSGSIQLTQSKWNEPVNTN

SEQ ID NO: 334 - protein, 589 aa, Mycobacterium leprae
VMRGVLVIMRLLCLGMLFTGCAGVPNSSAPQAIGTVERPVPSNLPKPTPGMDPDVLLREFFKATADPANRHLAARQFLTQSASNAWDDAGRALLIDHVVFVETRGAERVSATMRADILGSLSDMGVFETAEGVLPDPGPVELIKTSGGWRIDRLPNGVFLDWQQFQATYKRNTLYFADPTGKTVVPDPRYVAVLGHDQLATELVSKLLAGPRPEMAHAVRNLLAPPLRLRGPVTRADGSKSGIGRGYGGARIDLEKLSTTDPHSRQLLAAQIIWTLARADIRGPYVINADGAPLDDRFADGWTTSDVAATDPGVADGAGAGLHALVGGALVSLIGQNTTTVLGAFGRMGYQTGAALSRSGRQVASVVTLRRGAPDMAASLWIGDLGGEAVQSADGHSLSRPSWSLDDAVWVVVDTNNVLRAIPEPASGQPARIPVDSAAVASRFPGPITDLQLSRDGTRAAMVIGGQVILAGVEQTQAGQFALTYPRRLGFGLGSSVVSLSWRTGDDIVVTRTDATHPVSYVNLDGVNSDAPARGLQVPLSVIAANPSTVYVAGPQGVLQYSASVAESQQGWSEVAGLTVMGAEPVLPG

SEQ ID NO: 335 - protein, 183 aa, Mycobacterium leprae
VSRFKISLPALATRVAVLGFLTLMASVLGGCGAGQISQTATQEPAVNGNRVTLNNLALRDIRIQAAQTGDFLQSGRTVDLMLVAINNSPYVTDRLVSITSDIGTVALNGYTQLPTNGMLFIGTSEGQRIKPPPLQSNNIAKAIVTLAKPITNGLTYNFTFNFEKAGQANVAVPVSAGLAPRQT

SEQ ID NO: 336 - protein, 218 aa, Mycobacterium leprae
MQAIRLGLHTAAAVVTLSISAVSCGTKTPDYQLILSKSSTTTTTTPDKPIPLPQYLESIGVTGQQVAPSSLPGLTVSIPTPPGWSPYSNPNITPETLIIAKSGKYPTARLVAFKLRGDFDPTQVIKHGNDDAQLFENFRQLDVSTANYNGFPSAMIQGSYDLEGRRLHAWNRIVIPTGPPPSKQQYLVQLTITSLANEAVAQSNDIEAIIRGFVVAPK

SEQ ID NO: 337 - protein, 238 aa, Mycobacterium leprae
MQAPKHHRRLFAVLATLNTATAVIAGCSSGSNLSSGPLPDATTWVKQATDITKNVTSAHLVLSVNGKITGLPVKTLTGDLTTHPNTVASGNATITLDGADLNANFVVVDGELYATLTPSKWSDFGKASDIYDVASILNPDAGLANVLANFTGAKTEGRDSINGQSAVRISGNVSADAVNKIAPPFNATQPMPATVWIQETGDHQLAQIRIDNKSSGNSVQMTLSNWDEPVQVTKPQVS

SEQ ID NO: 338 - protein, 112 aa, Mycobacterium leprae
MAKKVTVTLVDDFDGAGAADETVEFGLDGVTYEIDLTNKNAAKLRGDLRQWVSAGRRVGGRRRGRSNSGRGRGAIDREQSAAIREWARRNGHNVSTRGRIPADVIDAFHAAT

SEQ ID NO: 339 - protein, 105 aa, Mycobacterium leprae
VALPQLTDEQRAAALEKAAAARRARAELKDRLKRGGTNLTQVLKDAESDEVLGKMKVSALLEALPKVGKVKAQEIMTELDIAPTRRLRGLGERQRKALLEKFGSA

SEQ ID NO: 340 - protein, 293 aa, Mycobacterium leprae
MSGPNPPGRENEESDSGNELSGELDPHNGVESVDELVPVPDSDLVTASDHTSETEVYSQAYSAPEAEHFTAVPYVPADLRLYDYDESSVYDEPGAAPRWPWVVGVAAILAAISLVVSVSLLFTRTDTSKLSTPTTGRSTPPVQDEITTVKPPPPSTETSTATETQTVTVTPLPPPSATSTAVPPSSVVPPPPTTPTTTVTTLTGPRQVTYSVTGTKAPGDIISVTYVDASGRRRTQHNVYIPWSMTVTPISQSDVGSVEAFSLFRVSKLNCLITTSDGTVLSSNSNDAPQTSC

SEQ ID NO: 341 - protein, 167 aa, Mycobacterium leprae
MTMKSIATYAALAIIGAAVDGLTSMAIPTGPAASHIQPVAFGVPLPQDPAPAADVPTAAELTSLLNKIVDPDVSFMHKSQLVEGGIGSAEAHIGDRELKNAAQKGELPLLFSVTNIRPGTSGSATADVSVSGPKLNPPVTQNITFINKGSWVLSRHSAMELLQAAGR

SEQ ID NO: 342 - protein, 84 aa, Mycobacterium leprae
MDWRHKAVCRDEDPELFFPVGNSGPAIAQIADAKLVCNRCPVTTECLAWALNTGQDSGVWGGMSEDERRALKRRNTRTKARSGV

SEQ ID NO: 343 - protein, 89 aa, Mycobacterium leprae
VVPKALVAFEVESEPESSDQWQDRALCAQTDPEAFFPEKGGSTREAKKICLGCEVRHECLEYALAHDERFGIWGGLSERERRRLKRGVI

SEQ ID NO: 344 - protein, 102 aa, Mycobacterium leprae
MPQPKQLPGPNATIWNWQLQGLCRGVDSSMFFHPDGERGRARMQREQRAKEMCRRCPVIEECRAHALDVGEPYGVWGGLSESERDLLLKGDLARSRSIPRSA

SEQ ID NO: 345 - protein, 304 aa, Mycobacterium tuberculosis
VTAPNEPGALSKGDGPNADGLVDRGGAHRAATGPGRIPDAGDPPPWQRAATRQSQAGHRQPPPVSHPEGRPTNPPAAADARLNRFISGASAPVTGPAAAVRTPQPDPDASLGCGDGSPAEAYASELPDLSGPTPRAPQRNPAPARPAEGGAGSRGDSAAGSSGGRSITAESRDARVQLSARRSRGPVRASMQIRRIDPWSTLKVSLLLSVALFFVWMITVAFLYLVLGGMGVWAKLNSNVGDLLNNASGSSAELVSSGTIFGGAFLIGLVNIVLMTALATIGAFVYNLITDLIGGIEVTLADRD

SEQ ID NO: 346 - protein, 141 aa, Mycobacterium tuberculosis
MQQTAWAPRTSGIAGCGAGGVVMAIASVTLVTDTPGRVLTGVAALGLILFASATWRARPRLAITPDGLAIRGWFRTQLLRHSNIKIIRIDEFRRYGRLVRLLEIETVSGGLLILSRWDLGTDPVEVLDALTAAGYAGRGQR

SEQ ID NO: 347 - protein, 93 aa, Mycobacterium tuberculosis
MPKSKVRKKNDFTVSAVSRTPMKVKVGPSSVWFVSLFIGLMLIGLIWLMVFQLAAIGSQAPTALNWMAQLGPWNYAIAFAFMITGLLLTMRWH

SEQ ID NO: 348 - protein, 527 aa, Mycobacterium tuberculosis
MGSQKRLVQRVERKLEQTVGDAFARIFGGSIVPQEVEALLRREAADGIQSLQGNRLLAPNEYIITLGVHDFEKLGADPELKSTGFARDLADYIQEQGWQTYGDVVVRFEQSSNLHTGQFRARGTVNPDVETHPPVIDCARPQSNHAFGAEPGVAPMSDNSSYRGGQGQGRPDEYYDDRYARPQEDPRGGPDPQGGSDPRGGYPPETGGYPPQPGYPRPRHPDQGDYPEQIGYPDQGGYPEQRGYPEQRGYPDQRGYQDQGRGYPDQGQGGYPPPYEQRPPVSPGPAAGYGAPGYDQGYRQSGGYGPSPGGGQPGYGGYGEYGRGPARHEEGSYVPSGPPGPPEQRPAYPDQGGYDQGYQQGATTYGRQDYGGGADYTRYTESPRVPGYAPQGGGYAEPAGRDYDYGQSGAPDYGQPAPGGYSGYGQGGYGSAGTSVTLQLDDGSGRTYQLREGSNIIGRGQDAQFRLPDTGVSRRHLEIRWDGQVALLADLNSTNGTTVNNAPVQEWQLADGDVIRLGHSEIIVRMH

SEQ ID NO: 349 - protein, 115 aa, Mycobacterium tuberculosis
MFLAGVLCMCAAAASALFGSWSLCHTPTADPTALALRAMAPTQLAAAVMLAAGGVVAVAAPGHTALMVVIVCIAGAVGTLAAGSWQSAQYALRRETASPTANCVGSCAVCTQACH

SEQ ID NO: 350 - protein, 310 aa, Mycobacterium tuberculosis
MIQIARTWRVFAGGMATGFIGVVLVTAGKASADPLLPPPPIPAPVSAPATVPPVQNLTALPGGSSNRFSPAPAPAPIASPIPVGAPGSTAVPPLPPPVTPAISGTLRDHLREKGVKLEAQRPHGFKALDITLPMPPRWTQVPDPNVPDAFVVIADRLGNSVYTSNAQLVVYRLIGDFDPAEAITHGYIDSQKLLAWQTTNASMANFDGFPSSIIEGTYRENDMTLNTSRRHVIATSGADKYLVSLSVTTALSQAVTDGPATDAIVNGFQVVAHAAPAQAPAPAPGSAPVGLPGQAPGYPPAGTLTPVPPR

SEQ ID NO: 351 - protein, 137 aa, Mycobacterium tuberculosis
VDYTLRRRSLLAEVYSGRTGVSEVCDANPYLLRAAKFHGKPSRVICPICRKEQLTLVSWVFGEHLGAVSGSARTAEELILLATRFSEFAVHVVEVCRTCSWNHLVKSYVLGAARPARPPRGSGGTRTARNGARTASE

SEQ ID NO: 352 - protein, 560 aa, Mycobacterium tuberculosis
VTGALSQSSNISPLPLAADLRSADNRDCPSRTDVLGAALANVVGGPVGRHALIGRTRLMTPLRVMFAIALVFLALGWSTKAACLQSTGTGPGDQRVANWDNQRAYYQLCYSDTVPLYGAELLSQGKFPYKSSWIETDSNGTPQLRYDGQIAVRYMEYPVLTGIYQYLSMAIAKTYTALSKVAPLPVVAEVVMFFNVAAFGLALAWLTTVWATSGLAGRRIWDAALVAASPLVIFQIFTNFDALATGLATSGLLAWARRRPVLAGVLIGLGSAAKLYPLLFLYPLLLLGIRAGRLNALARTMAAAAATWLLVNLPVMLLFPRGWSEFFRLNTRRGDDMDSLYNVVKSFTGWRGFDPTLGFWEPPLVLNTVVTLLFVLCCAAIAYIALTAPHRPRVAQLTFLTVASFLLVNKVWSPQFSLWLVPLAVLALPHRRILLAWMTIDALVWVPRMYYLYGNPSRSLPEQWFTTTVLLRDIAVMVLCGLVVWQIYRPGRDLVRTGGPGALPACGGVDDPVGGVFANAADAPPGRLPSWLRPRLGDEHARERTPDAGRDRTFSGQHRA

SEQ ID NO: 353 - protein, 282 aa, Mycobacterium tuberculosis
VLAQATTAGSFNHHASTVLQGCRGVPAAMWSEPAGAIRRHCATIDGMDCEVAREALSARLDGERAPVPSARVDEHLGECSACRAWFTQVASQAGDLRRLAESRPVVPPVGRLGIRRAPRRQHSPMTWRRWALLCVGIAQIALGTVQGFGLDVGLTHQHPTGAGTHLLNESTSWSIALGVIMVGAALWPSAAAGLAGVLTAFVAILTGYVIVDALSGAVSTTRILTHLPVVIGAVLAIMVWRSASGPRPRPDAVAAEPDIVLPDNASRGRRRGHLWPTDGSAA

SEQ ID NO: 354 - protein, 183 aa, Mycobacterium tuberculosis
MSHTDLTPCTRVLASSGTVPIAEELLARVLEPYSCKGCRYLIDAQYSATEDSVLAYGNFTIGESAYIRSTGHFNAVELILCFNQLAYSAFAPAVLNEEIRVLRGWSIDDYCQHQLSSMLIRKASSRFRKPLNPQKFSARLLCRDLQVIERTWRYLKVPCVIEFWDENGGAASGEIELAALNIP

SEQ ID NO: 355 - protein, 78 aa, Mycobacterium tuberculosis
VRDRILAAVCDVLYIDEADLIDGDETDLRDLGLDSVRFVLLMKQLGVNRQSELPSRLAANPSIAGWLRELEAVCTEFG

SEQ ID NO: 356 - protein, 251 aa, Mycobacterium tuberculosis
MRRVVRYLSVVVAITLMLTAESVSIATAAVPPLQPIPGVASVSPANGAVVGVAHPVVVTFTTPVTDRRAVERSIRISTPHNTTGHFEWVASNVVRWVPHRYWPPHTRVSVGVQELTEGFETGDALIGVASISAHTFTVSRNGEVLRTMPASLGKPSRPTPIGSFHAMSKERTVVMDSRTIGIPLNSSDGYLLTAHYAVRVTWSGVYVHSAPWSVNSQGYANVSHGCINLSPDNAAWYFDAVTVGDPIEVVG

SEQ ID NO: 357 - protein, 310 aa, Mycobacterium tuberculosis
MRTHDDTWDIKTSVGATAVMVAAARAVETDRPDPLIRDPYARLLVTNAGAGAIWEAMLDPTLVAKAAAIDAETAAIVAYLRSYQAVRTNFFDTYFASAVAAGIRQVVILASGLDSRAYRLDWPAGTIVYEIDQPKVLSYKSTTLAENGVTPSAGRREVPADLRQDWPAALRDAGFDPTARTAWLAEGLLMYLPAEAQDRLFTQVGAVSVAGSRIAAETAPVHGEERRAEMRARFKKVADVLGIEQTIDVQELVYHDQDRASVADWLTDHGWRARSQRAPDEMRRVGRWVEGVPMADDPTAFAEFVTAERL

SEQ ID NO: 358 - protein, 184 aa, Mycobacterium tuberculosis
MTAISCSPRPRYASRMPVLSKTVEVTADAASIMAIVADIERYPEWNEGVKGAWVLARYDDGRPSQVRLDTAVQGIEGTYIHAVYYPGENQIQTVMQQGELFAKQEQLFSVVATGAASLLTVDMDVQVTMPVPEPMVKMLLNNVLEHLAENLKQRAEQLAASGMCGLSRRLRSQPGPPSACVPHR

SEQ ID NO: 359 - protein, 213 aa, Mycobacterium tuberculosis
VKAADSAESDAGADQTGPQVKAADSAESDAGELGEDACPEQALVERRPSRLRRGWLVGIAATLLALAGGLGAAGYFALRSHQESQSIAREDLAAIEAAKDCVAATQAPDAGAMSASMQKIIECGTGDFGAQASLYTSMLVEAYQAASVHVQVTDMRAAVERNNNDGSVDVLVALRVKVSNTDSDAHEVGYRLRVRMALDEGRYKIAKLDQVTK

SEQ ID NO: 360 - protein, 322 aa, Mycobacterium tuberculosis
VTVVVEKTPTTLPQATPNGAAPWHVRAGAFAIDVLPGLAVAATMALTALTVPPGSAWRWLCACLLGLTILLLAVNRLLLPTITGWSLGRALTGIRVVRRDGSAIGPWRLLVRDLAHLVDTLSLFVGWLWPLWDSRRRTFADLLLRTEVRRVEPVQRPAVIRRLTAAVALAAAGACASATAVGAAVVYVNEWQTDHTRAQLATRGPKLVVDVLSYDPETVQRDFERARSLATDRYRPQLSIQQDSVRESGPVRNQYWVTDSAVLSATPAQATMLLFMQGERGTPPNQRYIQSTVRAIFQKSRGQWRLDDLAVVMKPRQPTGEK

SEQ ID NO: 361 - protein, 184 aa, Mycobacterium tuberculosis
MSPRRKFEPGEGALLAPQSIEPSRRWGLPLALTASAVVMAAAISACALMRISHESHQRAAHKDIVMLSDVRSFMTMFTSPDPFHANEYAERVLSHATGDFAKQYHERANDILIRISGVEPTTGTVLDAGVQRWNEDGSANVLVVTQITSKSADGKRVVSNANRWLVTAKQEGNEWKISSLLPVI

SEQ ID NO: 362 - protein, 244 aa, Mycobacterium tuberculosis
VEDQQSASGDLTQKSVANGESTDTASAATEGHRGEIDAAGEPDERGAAVADSQADEDDSAATAARGGKTRARRSRGRRLAITVGVAAALFVGSAAFAGATVEPYLSERAVVATKLMVARTAANAITTLWTYTPENMDTLADRAANYLSGDFAAQYRRFVDQIAAANKQAKITNDTEVTGAAVESLSGRDAVAIVYTNTTTTSPVTKNIPALKYLSYRLFMKRYDARWLVTRMTTITSLDLTPQV

SEQ ID NO: 363 - protein, 249 aa, Mycobacterium tuberculosis
MTNDKMLARIAALLRQAEGTDNPHEADAFMSTAQRLATAASIDLAVARSHAGNRSPAQAPTQRTITIGAAGTRGLRTYVQLFVLIAAANDVRCDVASNSTFVYAYGFAEDIDTSHALYASLVVQMVRASDAYLASGAHRPTPTITARLNFQLAFGARVGQRLADAREQTRQEATKDRDRPPGTAIALRDKDIELHEYYRRSSKARGAWRASRATAGYSSAARRAGDRAGRQARLGNNPELPGARAALGR

SEQ ID NO: 364 - protein, 169 aa, Mycobacterium tuberculosis
VIGADVPRDSQRARVYAAEAFVRTLFDRVTAHGSPTVEFFGTQLTLPPEGRFGSVASVQRYVDDVLALPAVGQNWPTVSPVRVRARRAATAAHYENHGGTGTIAVPDRHTAGWAMRELVVLHEVAHHLCQVPPPHGPEFVATVCTLTELVMGPEVGHVFRVVYAQEGVR

SEQ ID NO: 365 - protein, 219 aa, Mycobacterium tuberculosis
MPDGEQSQPPAQEDAEDDSRPDAAEAAAAEPKSSAGPMFSTYGIASTLLGVLSVAAVVLGAMIWSAHRDDSGERTYLTRVMLTAAEWTAVLINMNADNIDASLQRLHDGTVGQLNTDFDAVVQPYRQVVEKLRTHSSGRIEAVAIDTVHRELDTQSGAARPVVTTKLPPFATRTDSVLLVATSVSENAGAKPQTVHWNLRLDVSDVDGKLMISRLESIR

SEQ ID NO: 366 - protein, 229 aa, Mycobacterium tuberculosis
MRNAWRLVVFDVLAPLATIAALAAIGVLLGWPLWWVSTCSVLVLLVVEGVAINFWLLRRDSVTVGTDDDAPGLRLAVVFLCAAAISAAVVTGYLRWTTPDRDFNRDSREVVHLATGMAETVASFSPSAPAAAVDRAAAMMVPEHAGGFKEQYAKSSADLARRGVTAQAATLAAGVEAIGPSAASVAVILRVSQSIPGQPTSQAARALRVTLTKRGSGWLVLDVTPINAR

SEQ ID NO: 367 - protein, 167 aa, Mycobacterium tuberculosis
VTLAAEPHPAPPQQPTVAWSEPDVDRRVEFWPTVAIRSALESGDIATWQRIAAALKRDPYGRTARQVEEVLEGIPATGIANAFWEVLDRARTHLDANERAEVARQVGLLLDRSGLQRQEFASRIGVTAQDLTAYLDGIVSPSASLMIRMRRLSDRFVRAKSVRAADS

SEQ ID NO: 368 - protein, 242 aa, Mycobacterium tuberculosis
MSLTEDVTSQTSESLARHSVLAEDLSQDGLTSLGAPGARVLLVWDAPNLDMGLGSILGRRPTALERPRFDALGRWLLARTAEIVAGRPGISTEPEATVFTNIAPGSAEVVRPWVDALRNVGFAVFAKPKVDEDSDVDRDMLAHIDERYREGLAALVVASADGQAFRQPLEAVARSGTPVQVLGFREHASWALASDTLEFVDLEDIAGVFREPLPRIGLDSLPEQGAWLQPFRPLSSLLTSRV

SEQ ID NO: 369 - protein, 337 aa, Mycobacterium tuberculosis
VASGYGGIRVGGPYFDDLSKGQVFDWAPGVTLSLGLAAAHQSIVGNRLRLALDSDLCAAVTGMPGPLAHPGLVCDVAIGQSTLATQRVKANLFYRGLRFHRFPAVGDTLYTRTEVVGLRANSPKPGRAPTGLAGLRMTTIDRTDRLVLDFYRCAMLPASPDWKPGAVPGDDLSRIGADAPAPAADPTAHWDGAVFRKRVPGPHFDAGIAGAVLHSTADLVSGAPELARLTLNIAATHHDWRVSGRRLVYGGHTIGLALAQATRLLPNLATVLDWESCDHTAPVHEGDTLYSELHIESAQAHADGGVLGLRSLVYAVSDSASEPDRQVLDWRFSALQF

SEQ ID NO: 370 - protein, 576 aa, Mycobacterium tuberculosis
VRWFRPGYALVLVLLLAAPLLRPGYLLLRDAVSTPRSYVSANALGLTSAPRATPQDFAVALASHLVDGGVVVKALLLLGLWLAGWGAARLVATALPAAGAAGQFVAITLAIWNPYVAERLLQGHWSLLVGYGCLPWVATAMLTMRTTVGAGWFGLFGLAFWVALAGLTPSGLLLAATVAVVCVAMPGAGRPRWQCGVAALGSALVGALPWLTASALGSSLTSHTAANQLGVTAFAPRAEPGLGTLGSLASLGGIWNGEAVPSSRTTLFAVASAVVLLAMVAIGLPTVARRPVAVPLLTLAAVSVMVPAVLATGPGLHALRVVVDAAPGLGVLRDGQKWVALAVPGYTLSGAGTVLTLRRWLRPATAAVVCCLALVLTLPDLAWGVWGKVAPVHYPSGWAAVAAAINADPRTVAVLPAGTMRRFSWSGSAPVLDPLPRWVRADVLTTGDLVISGVTVPGEDAHARAVQELLLTGPHPSTLAAAGVGWLVVESDSAGDMGAAARTLGRLAAAHRDDELALYRVGGQTSGASSARLKATMLAHWAWLSMLLVGGAGAAGYWVRRHLHHCEDTPASRAQD

SEQ ID NO: 371 - protein, 421 aa, Mycobacterium tuberculosis
MLRFAACGAIGLGAALLIAALLLSTYTTSRIAEIPLDIDATLISDGTGTALDSASLATEHIVVNQDVPLVSQQQVTVESPANADVVTLQVGSSLRRTDKQKDSGLLLAIVDTVTLNRKTAMAVSDDTHTGGAVQKPRGLNDENPPTAIPLRHDGLSYRFPFHTEKKTYPYFDPIAQKAFDANYEGEEDVNGLTTYRFTQNVGYTPEGKLVAPLKYPSLYAGDEDGKVTTSAAMWGLPGDPNEQITMTRYYAAQRTFWVDPVSGTIVKETERANHYFARDPLKPEVTFADYQVTSTEETVESQVNAARDERDRLALWSRVLPITFTAAGLVALVGGGLFASFSLRTEGALMAASGDRDDHDYRRGGFEEPVPGAEAETEKLPTQRPDFPREPSGSDPPRLGSAQPPPPPDAGHPDPGPPERR

SEQ ID NO: 372 - protein, 57 aa, Mycobacterium tuberculosis
MNRIVAPAAASVVVGLLLGAAAIFGVTLMVQQDKKPPLPGGDPSSSVLNRVEYGNRS

SEQ ID NO: 373 - protein, 1400 aa, Mycobacterium tuberculosis
VAPLSRKWLPVVGAVALALTFAQSPGQVSPDTKLDLTANPLRFLARATNLWNSDLPFGQAQNQAYGYLFPHGTFFVIGHLLGVPGWVTQRLWWAVLLTVGFWGLLRVAEALGVGGPSSRVVGAVAFALSPRVLTTLGSISSETLPMMLAPWVLLPTILALRGTSGRSVRALAAQAGLAVALMGAVNAIATLAGCLPAVIWWACHRPNRLWWRYTAWWLLAMALATLWWVMALTQLHGVSPPFLDFIESSGVTTQWSSLVEVLRGTDSWTPFVAPNATAGAPLVTGSAAILGTCLVAAAGLAGLTSPAMPARGRLVTMLLVGVVLLAVGHRGGLASPVAHPVQAFLDAAGTPLRNVHKVGPVIRLPLVLGLAQLLSRVPLPGSAPRPAWLRAFAHPERDKRVAVAVVALTALMVSTSLAWTGRVAPPGTFGALPQYWQEAADWLRTHHAATPTPGRVLVVPGAPFATQVWGTSHDEPLQVLGDGPWGVRDSIPLTPPQTIRALDSVQRLFAAGRPSAGLADTLARQGISYVLVRNDLDPETSRSARPILLHRSIAGSPGLAKLAEFGAPVGPDPLAGFVNDSGLRPRYPAIEIYRVSAPANPGAPYFAATDQLARVDGGPEVLLRLDERRRLQGQPPLGPVLMTADARAAGLPVPQVAVTDTPVARETDYGRVDHHSSAIRAPGDARHTYNRVPDYPVPGAEPVVGGWTGGRITVSSSSADATAMPDVAPASAPAAAVDGDPATAWVSNALQAAVGQWLQVDFDRPVTNAVVTLTPSATAVGAQVRRILIETVNGSTTLRFDEAGKPLTAALPYGETPWVRFTAAATDDGSAGVQFGITDLAITQYDASGFAHPVQLRHTVLVPGPPPGSAIAGWDLGSELLGRPGCAPGPDGVRCAASMALAPEEPANLSRTLTVPRPVSVTPMVWVRPRQGPKLADLIAAPSTTRASGDSDLVDILGSAYAAADGDPATAWTAPQRVVQHKTPPTLTLTLPRPTVVTGLRLAASRSMLPAHPTVVAINLGDGPQVRQLQVGELTTLWLHPRVTDTVSVSLLDWDDVIDRNALGFDQLKPPGLAEVVVLSAGGAPIAPADAARNRARALTVDCDHGPVVAVAGRFVHTSIRTTVGALLDGEPVAALPCEREPIALPAGQQELLISPGAAFVVDGAQLSTPGAGLSSATVTSAETGAWGPTHREVRVPESATSRVLVVPESINSGWVARTSTGARLTPIAVNGWQQAWVVPAGNPGTITLTFAPNSLYRASLAIGLALLPLLALLAFWRTGRRQLADRPTPPWRPGAWAAAGVLAAGAVIASIAGVMVMGTALGVRYALRRRERLRDRVTVGLAAGGLILAGAALSRHPWRSVDGYAGNWASVQLLALISVSVVAASVVATSESRGQDRMQ

SEQ ID NO: 374 - protein, 280 aa, Mycobacterium tuberculosis
VTQPSGLKNLLRAAAGALPVVPRTDQLPNRTVTVEELPIDPANVAAYAAVTGLRYGNQVPLTYPFALTFPSVMSLVTGFDFPFAAMGAIHTENHITQYRPIAVTDAVGVRVRAENLREHRRGLLVDLVTNVSVGNDVAWHQVTTFLHQQRTSLSGEPKPPPQKKPKLPPPAAVLRITPAKIRRYAAVGGDHNPIHTNPIAAKLFGFPTVIAHGMFTAAAVLANIEARFPDAVRYSVRFAKPVLLPATAGLYVAEGDGGWDLTLRNMAKGYPHLTATVRGL

SEQ ID NO: 375 - protein, 97 aa, Mycobacterium tuberculosis
LSTTAELAELHDLVGGLRRCVTALKARFGDNPATRRIVIDADRILTDIELLDTDVSELDLERAAVPQPSEKIAIPDTEYDREFWRDVDDEGVGGHRY

SEQ ID NO: 376 - protein, 124 aa, Mycobacterium tuberculosis
MTRVSWLPDRCLPRLPACGRGLRGSLPGDSGGTAPDSHRLPASSSPDGKNIGMQSVDLHVERHLPSRGRSHRTVATVTCVTALGDIRSAQLSATGAWPAVLFPSWSWLCGIGGGVDLQKPSCRA

SEQ ID NO: 377 - protein, 538 aa, Mycobacterium tuberculosis
MTNQQHDHDFDHDRRSFASRTPVNNNPDKVVYRRGFVTRHQVTGWRFVMRRIAAGIALHDTRMLVDPLRTQSRAVLMGVLIVITGLIGSFVFSLIRPNGQAGSNAVLADRSTAALYVRVGEQLHPVLNLTSARLIVGRPVSPTTVKSTELDQFPRGNLIGIPGAPERMVQNTSTDANWTVCDGLNAPSRGGADGVGVTVIAGPLEDTGARAAALGPGQAVLVDSGAGTWLLWDGKRSPIDLADHAVTSGLGLGADVPAPRIIASGLFNAIPEAPPLTAPIIPDAGNPASFGVPAPIGAVVSSYALKDSGKTISDTVQYYAVLPDGLQQISPVLAAILRNNNSYGLQQPPRLGADEVAKLPVSRVLDTRRYPSEPVSLVDVTRDPVTCAYWSKPVGAATSSLTLLAGSALPVPDAVHTVELVGAGNGGVATRVALAAGTGYFTQTVGGGPDAPGAGSLFWVSDTGVRYGIDNEPQGVAGGGKAVEALGLNPPPVPIPWSVLSLFVPGPTLSRADALLAHDTLVPDSRPARPVSAEGGYR

SEQ ID NO: 378 - protein, 96 aa, Mycobacterium tuberculosis
MSQIMYNYPAMLGHAGDMAGYAGTLQSLGAEIAVEQAALQSAWQGDTGITYQAWQAQWNQAMEDLVRAYHAMSSTHEANTMAMMARDTAEAAKWGG

SEQ ID NO: 379 - protein, 295 aa, Mycobacterium tuberculosis
MDATPNAVELTVDNAWFIAETIGAGTFPWVLAITMPYSDAAQRGAFVDRQRDELTRMGLLSPQGVINPAVADWIKVVCFPDRWLDLRYVGPASADGACELLRGIVALRTGTGKTSNKTGNGVVALRNAQLVTFTAMDIDDPRALVPILGVGLAHRPPARFDEFSLPTRVGARADERLRSGVPLGEVVDYLGIPASARPVVESVFSGPRSYVEIVAGCNRDGRHTTTEVGLSIVDTSAGRVLVSPSRAFDGEWVSTFSPGTPFAIAVAIQTLTACLPDGQWFPGQRVSRDFSTQSS

SEQ ID NO: 380 - protein, 472 aa, Mycobacterium tuberculosis
MSGTVMQIVRVAILADSRLTEMALPAELPLREILPAVQRLVVPSAQNGDGGQADSGAAVQLSLAPVGGQPFSLDASLDTVGVVDGDLLVLQPVPAGPAAPGIVEDIADAAMIFSTSRLKPWGIAHIQRGALAAVIAVALLATGLTVTYRVATGVLAGLLAVAGIAVASALAGLLITIRSPRSGIALSIAALVPIGAALALAVPGKFGPAQVLLGAAGVAAWSLIALMIPSAERERVVAFFTAAAVVGASVALAAGAQLLWQLPLLSIGCGLIVAALLVTIQAAQLSALWARFPLPVIPAPGDPTPSAPPLRLLEDLPRRVRVSDAHQSGFIAAAVLLSVLGSVAIAVRPEALSVVGWYLVAATAAAATLRARVWDSAACKAWLLAQPYLVAGVLLVFYTATGRYVAAFGAVLVLAVLMLAWVVVALNPGIASPESYSLPLRRLLGLVAAGLDVSLIPVMAYLVGLFAWVLNR

SEQ ID NO: 381 - protein, 331 aa, Mycobacterium tuberculosis
MNPIPSWPGRGRVTLVLLAVVPVALAYPWQSTRDYVLLGVAAAVVIGLFGFWRGLYFTTIARRGLAILRRRRRIAEPATCTRTTVLVWVGPPASDTNVLPLTLIARYLDRYGIRADTIRITSRVTASGDCRTWVGLTVVADDNLAALQARSARIPLQETAQVAARRLADHLREIGWEAGTAAPDEIPALVAADSRETWRGMRHTDSDYVAAYRVSANAELPDTLPAIRSRPAQETWIALEIAYAAGSSTRYTVAAACALRTDWRPGGTAPVAGLLPQHGNHVPALTALDPRSTRRLDGHTDAPADLLTRLHWPTPTAGAHRAPLTNAVSRT

SEQ ID NO: 382 - protein, 218 aa, Mycobacterium tuberculosis
MSRLLALLCAAVCTGCVAVVLAPVSLAVVNPWFANSVGNATQVVSVVGTGGSTAKMDVYQRTAAGWQPLKTGITTHIGSAGMAPEAKSGYPATPMGVYSLDSAFGTAPNPGGGLPYTQVGPNHWWSGDDNSPTFNSMQVCQKSQCPFSTADSENLQIPQYKHSVVMGVNKAKVPGKGSAFFFHTTDGGPTAGCVAIDDATLVQIIRWLRPGAVIAIAK

SEQ ID NO: 383 - protein, 128 aa, Mycobacterium tuberculosis
VGDYGPFGFDPDEFDRVIREGSEGLRDAFERIGRFLSSSGAGTGWSAIFEDLSRRSRPAPETAGEAGDGVWAIYTVDADGGARVEQVYATELDALRANKDNTDPKRKVRFLPYGIAVSVLDDPVDEAQ

SEQ ID NO: 384 - protein, 214 aa, Mycobacterium tuberculosis
VTDASVHPDELDPEYHHHGGFPEYGPASPGAGFGQFVATMRRLQDLAVAADPGDAVWDEAAERAAALVELLSPFEADEGKAPAGRTPGLPGMGSLLLPPWTVTRYGTDGVEMRGSFSRFHVGGNSAVHGGVLPLLFDHMFGMISHAAGRPISRTAFLHVDYRRITPIDVPLIVRGRVTNTEGRKAFVCAELFDSDETLLAEGNGLMVRLLPGQP

SEQ ID NO: 385 - protein, 215 aa, Mycobacterium tuberculosis
MYTAENAPGVAVLLSGDADVPGPLTGLPTHQDNLDTVIGRYSRLIVVGADADLGAVLTRLLRTDRLDVEVGYVPRRRSPATRAYRLPAGRRAARRARCGVARRVPLIRDETGSVIVGRAQWLPAEEQALIHGEAVVDDTVLFDGDVAGVCIEPTLTLPGLRAAVDGAGKWRRWIGGRAAQLGTTGAAVLRDGVAAPRPVRRSTFYRNVEGWLLVR

SEQ ID NO: 386 - protein, 145 aa, Mycobacterium tuberculosis
VTKRTITPMTSMGDLLGPEPILLPGDSDAEAELLANESPSIVAAAHPSASVAWAVLAEGALADDKTVTAYAYARTGYHRGLDQLRRHGWKGFGPVPYSHQPNRGFLRCVAALARAAAAIGETDEYGRCLDLLDDCDPAARPALGL

SEQ ID NO: 387 - protein, 275 aa, Mycobacterium tuberculosis
MSNAPEPDRSAGESGSEPAGERSADPGEERTESYPLVPHDAETETVVITTSDNDAAVTQPEAQRERRFTAPGFDAKETQVIVTAHEAATEVFQTNQAPTTPPRMPTGMPPKTAVPQSIPPRTEATSVRQRTWGWALAVVVIVLALAAIAILGTVLLTRGKHSKMSQEDQVRQAIQSLDIAIQTGDLTALRSLTCGSTRDGYVDYDERDWAETYRRVSAAKQYPVIASIDQVVVNGAHAEANVTTFMAFDPQVRSTRSLDLQFRDDQWKICQSSSN

SEQ ID NO: 388 - protein, 284 aa, Mycobacterium tuberculosis
MVPLWFTLSALCFVGAVVLLYVDIDRRRGRSRRRKSWARSHGFDYERESTEILKRWTRGVMSTVGDVAAHNVVLGQIRGEAVYIFDLEEVATVIALHRKVGTNVVVDLRLKGLKEPRESDIWLLGAIGPRMVYSTNLDAARRACDRRMVTFAHTAPDCAEIMWNEQNWTLVSMPIASTRAQWDEGLRTVRQFNDLLRVLPPLPQEMPQQTGVGPRGAAPGRPVAPGGPAELPPRRAQPDPATTVLPDPARRAPEPIRRDEGRSEGVRRPPPAGRNGQQATNYQH

SEQ ID NO: 389 - protein, 123 aa, Mycobacterium tuberculosis
MRPRRALAGLAADVVAVLVFCAVGRRSHAEGLSVTGLAATAWPFLTGTGIGWVLARGWRRPTALAPTGVIVWLCTIVVGMVLRKVSSAGVAASFVVVASAVTAVLLLGWRAAVALMAPHRADG

SEQ ID NO: 390 - protein, 68 aa, Mycobacterium tuberculosis
MIVVVNEQQVEVDEQTTIAALLDSLGFGDRGIAVALNFSVLPRSDWATKICELRKPVRLEVVTAVQGG

SEQ ID NO: 391 - protein, 102 aa, Mycobacterium tuberculosis
MDSAMARAIRSGDDAEVADGLTRREHDILAFERQWWKFAGVKEEAIKELFSMSATRYYQVLNALVDRPEALAADPMLVKRLRRLRASRQKARAARRLGFEVT

SEQ ID NO: 392 - protein, 164 aa, Mycobacterium tuberculosis
VLVTVGSMNERVPDSSGLPLRAMVMVLLFLGVVFLLLVWQALGSSPNSEDDSSAISTMTTTTAAPTSTSVKPAAPRAEVRVYNISGTEGAAARTADRLKAAGFTVTDVGNLSLPDVAATTVYYTEVEGERATADAVGRTLGAAVELRLPELSDQPPGVIVVVTG

SEQ ID NO: 393 - protein, 148 aa, Mycobacterium tuberculosis
MSRLSSILRAGAAFLVLGIAAATFPQSAAADSTEDFPIPRRMIATTCDAEQYLAAVRDTSPVYYQRYMIDFNNHANLQQATINKAHWFFSLSPAERRDYSEHFYNGDPLTFAWVNHMKIFFNNKGVVAKGTEVCNGYPAGDMSVWNWA

SEQ ID NO: 394 - protein, 97 aa, Mycobacterium tuberculosis
MTRRASTDTPQIIMGAIGGVVTGYILWLAAISVGDGLTTVSQWSRVVLLLSVLVAVCGAAGGLRLRSRGKLAWSAFAFSLPIPPVVLTVAVLADIYL

SEQ ID NO: 395 - protein, 190 aa, Mycobacterium tuberculosis
MTGQNGQVARISPGKFRQLGPVNWLVAKLAARAVGAPQMHLFTTLGYRQYLFWTFAIYTGRLLHGRLPGVDTELVILRVAHLRSCEYELQHHRRMARRRGLDANTQATIFAWPDVPDGDGPRKVLSARQQALLQATDELIKDRTITAGTWERLATHLDPRLLIEFCLLATQYDAIAATITALAIPPDNPQ

SEQ ID NO: 396 - protein, 264 aa, Mycobacterium tuberculosis
VSLDKKLMPVPDGHPDVFDREWPLRVGDIDRAGRLRLDAACRHIQDIGQDQLREMGFEETHPLWIVRRTMVDLIRPIEFGDMLRCRRWCSGTSNRWCEMRVRVDGRKGGLIESEAFWIHVNRETEMPARIADDFLAGLHRTTSVDRLRWKGYLKPGSRDDASEIHEFPVRVTDIDLFDHMNNAVYWSVIEDYLASHAELLRGPLRVTIEHEAPVALGDKLEIISHVHPAGSTEIFGPGLVDRAVTTLTYVVGDEPKAVASLFNL

SEQ ID NO: 397 - protein, 87 aa, Mycobacterium tuberculosis
MLVLLVAVLVTAVYAFVHAALQRPDAYTAADKLTKPVWLVILGAAVALASILYPVLGVLGMAMSACASGVYLVDVRPKLLEIQGKSR

SEQ ID NO: 398 - protein, 148 aa, Mycobacterium tuberculosis
MKALVAVSAVAVVALLGVSSAQADPEADPGAGEANYGGPPSSPRLVDHTEWAQWGSLPSLRVYPSQVGRTASRRLGMAAADAAWAEVLALSPEADTAGMRAQFICHWQYAEIRQPGKPSWNLEPWRPVVDDSEMLASGCNPGSPEESF

SEQ ID NO: 399 - protein, 348 aa, Mycobacterium tuberculosis
VTNPQGPPNDPSPWARPGDQGPLARPPASSEASTGRLRPGEPAGHIQEPVSPPTQPEQQPQTEHLAASHAHTRRSGRQAAHQAWDPTGLLAAQEEEPAAVKTKRRARRDPLTVFLVLIIVFSLVLAGLIGGELYARHVANSKVAQAVACVVKDQATASFGVAPLLLWQVATRHFTNISVETAGNQIRDAKGMQIKLTIQNVRLKNTPNSRGTIGALDATITWSSEGIKESVQNAIPILGAFVTSSVVTHPADGTVELKGLLNNITAKPIVAGKGLELQIINFNTLGFSLPKETVQSTLNEFTSSLTKNYPLGIHADSVQVTSTGVVSRFSTRDAAIPTGIQNPCFSHI

SEQ ID NO: 400 - protein, 451 aa, Mycobacterium tuberculosis
VVIRVLFRPVSLIPVNNSSTPQSQGPISRRLALTALGFGVLAPNVLVACAGKVTKLAEKRPPPAPRLTFRPADSAADVVPIAPISVEVGDGWFQRVALTNSAGKVVAGAYSRDRTIYTITEPLGYDTTYTWSGSAVGHDGKAVPVAGKFTTVAPVKTINAGFQLADGQTVGIAAPVIIQFDSPISDKAAVERALTVTTDPPVEGGWAWLPDEAQGARVHWRPREYYPAGTTVDVDAKLYGLPFGDGAYGAQDMSLHFQIGRRQVVKAEVSSHRIQVVTDAGVIMDFPCSYGEADLARNVTRNGIHVVTEKYSDFYMSNPAAGYSHIHERWAVRISNNGEFIHANPMSAGAQGNSNVTNGCINLSTENAEQYYRSAVYGDPVEVTGSSIQLSYADGDIWDWAVDWDTWVSMSALPPPAAKPAATQIPVTAPVTPSDAPTPSGTPTTTNGPGG

SEQ ID NO: 401 - protein, 183 aa, Mycobacterium tuberculosis
VTSSLPTVQRVIQNALEVSQLKYSQHPRPGGAPPALIVELPGERKLKINTILSVGEHSVRVEAFVCRKPDENREDVYRFLLRRNRRLYGVAYTLDNVGDIYLVGQMALSAVDADEVDRVLGQVLEVVDSDFNALLELGFRSSIQREWQWRLSRGESLQNLQAFAHLRPTTMQSAQRDEKELGG

SEQ ID NO: 402 - protein, 296 aa, Mycobacterium tuberculosis
VWRPAQGARWHVPAVLGYGGIPRRASWSNVESVANSRRRPVHPGQEVELDFAREWVEFYDPDNPEHLIAADLTWLLSRWACVFGTPACQGTVAGRPNDGCCSHGAFLSDDDDRTRLADAVHKLTDDDWQFRAKGLRRKGYLELDEHDGQPQHRTRKHKGACIFLNRPGFAGGAGCALHSKALKLGVPPLTMKPDVCWQLPIRRSQEWVTRPDGTEILKTTLTEYDRRGWGSGGADLHWYCTGDPAAHVGTKQVWQSLADELTELLGEKAYGELAAMCKRRSQLGLIAVHPATRAAQ

SEQ ID NO: 403 - protein, 310 aa, Mycobacterium tuberculosis
MTGPHPETESSGNRQISVAELLARQGVTGAPARRRRRRRGDSDAITVAELTGEIPIIRDDHHHAGPDAHASQSPAANGRVQVGEAAPQSPAEPVAEQVAEEPTRTVYWSQPEPRWPKSPPQDRRESGPELSEYPRPLRHTHSDRAPAGPPSGAEHMSPDPVEHYPDLWVDVLDTEVGEAEAETEVREAQPGRGERHAAAAAAGTDVEGDGAAEARVARRALDVVPTLWRGALVVLQSILAVAFGAGLFIAFDQLWRWNSIVALVLSVMVILGLVVSVRAVRKTEDIASTLIAVAVGALITLGPLALLQSG

SEQ ID NO: 404 - protein, 280 aa, Mycobacterium tuberculosis
VRPAIKVGLSTASVYPLRAEAAFEYADRLGYDGVELMVWGESVSQDIDAVRKLSRRYRVPVLSVHAPCLLISQRVWGANPILKLDRSVRAAEQLGAQTVVVHPPFRWQRRYAEGFSDQVAALEAASTVMVAVENMFPFRADRFFGAGQSRERMRKRGGGPGPAISAFAPSYDPLDGNHAHYTLDLSHTATAGTDSLDMARRMGPGLVHLHLCDGSGLPADEHLVPGRGTQPTAEVCQMLAGSGFVGHVVLEVSTSSARSANERESMLAESLQFARTHLLR

SEQ ID NO: 405 - protein, 33 aa, Mycobacterium tuberculosis; identical to SEQ ID NO: 279

SEQ ID NO: 406 - protein, 166 aa, Mycobacterium tuberculosis
MTVPEEAQTLIGKHYRAPDHFLVGREKIREFAVAVKDDHPTHYSEPDAAAAGYPALVAPLTFLAIAGRRVQLEIFTKFNIPINIARVFHRDQKFRFHRPILANDKLYFDTYLDSVIESHGTVLAEIRSEVTDAEGKPVVTSVVTMLGEAAHHEADADATVAAIASI

SEQ ID NO: 407 - protein, 529 aa, Mycobacterium tuberculosis
MWRSLTSMGTALVLLFLLALAAIPGALLPQRGLNAAKVDDYLAAHPLIGPWLDELQAFDVFSSFWFTAIYVLLFVSLVGCLAPRTIEHARSLRATPVAAPRNLARLPKHAHARLAGEPAALAATITGRLRGWRSITRQQGDSVEVSAEKGYLREFGNLVFHFALLGLLVAVAVGKLFGYEGNVIVIADGGPGFCSASPAAFDSFRAGNTVDGTSLHPICVRVNNFQAHYLPSGQATSFAADIDYQADPATADLIANSWRPYRLQVNHPLRVGGDRVYLQGHGYAPTFTVTFPDGQTRTSTVQWRPDNPQTLLSAGVVRIDPPAGSYPNPDERRKHQIAIQGLLAPTEQLDGTLLSSRFPALNAPAVAIDIYRGDTGLDSGRPQSLFTLDHRLIEQGRLVKEKRVNLRAGQQVRIDQGPAAGTVVRFDGAVPFVNLQVSHDPGQSWVLVFAITMMAGLLVSLLVRRRRVWARITPTTAGTVNVELGGLTRTDNSGWGAEFERLTGRLLAGFEARSPDMAEAAAGTGRDVD

SEQ ID NO: 408 - protein, 105 aa, Mycobacterium tuberculosis
VSEAPNDKTTRGVVDILVYATARLLLVVAVSAAIFGVARLIGLTEFPVVVATLFGLIIAMPLGIWVFSPLRRRATAALAVAGERRRAERERLRARLRGESLPEEQ

SEQ ID NO: 409 - protein, 100 aa, Mycobacterium tuberculosis
VNRFLTSIVAWLRAGYPEGIPPTDSFAVLALLCRRLSHDEVKAVANELMRLGDFDQIDIGVVITHFTDELPSPEDVERVRARLAAQGWPLDDVRDREEHA

SEQ ID NO: 410 - protein, 92 aa, Mycobacterium tuberculosis
VSAWFNYTATLKILIFSLLAGALLPGLFAVGVRLQAAGDGADATARRRPLLVAVSWAIFALVLAVVIIGVLYIARDFIAHHTGWAFLGATPK

SEQ ID NO: 411 - protein, 128 aa, Mycobacterium tuberculosis
MEILASRMLLRPADYQRSLSFYRDQIGLAIAREYGAGTVFFAGQSLLELAGYGEPDHSRGPFPGALWLQVRDLEATQTELVSRGVSIAREPRREPWGLHEMHVTDPDGITLIFVEVPEGHPLRTDTRA

SEQ ID NO: 412 - protein, 171 aa, Mycobacterium tuberculosis
VISPKPLLHILIHGLSDELPDTRGRIVLRWLRIAVLIVTGLVTLQSVLLVAGAWRNDIAIQRNMGVAQAEVLSAGPRRSTIEFVTPDRITYRPQLGVLYPSELSTGMRIYVEYNKRDPNLVRVQHRNAGLAIIPAGSIAVVAWLIAAAALVVLAVLDKRLERRENSASATG

SEQ ID NO: 413 - protein, 112 aa, Mycobacterium tuberculosis
MKGTKLAVVVGMTVAAVSLAAPAQADDYDAPFNNTIHRFGIYGPQDYNAWLAKISCERLSRGVDGDAYKSATFLQRNLPRGTTQGQAFQFLGAAIDHYCPEHVGVLQRAGTR

SEQ ID NO: 414 - protein, 83 aa, Mycobacterium tuberculosis
LGSDCGCGGYLWSMLKRVEIEVDDDLIQKVIRRYRVKGAREAVNLALRTLLGEADTAEHGHDDEYDEFSDPNAWVPRRSRDTG

SEQ ID NO: 415 - protein, 158 aa, Mycobacterium tuberculosis
VALSADIVGMHYRYPDHYEVEREKIREYAVAVQNDDAWYFEEDGAAELGYKGLLAPLTFICVFGYKAQAAFFKHANIATAEAQIVQVDQVLKFEKPIVAGDKLYCDVYVDSVREAHGTQIIVTKNIVTNEEGDLVQETYTTLAGRAGEDGEGFSDGAA

SEQ ID NO: 416 - protein, 142 aa, Mycobacterium tuberculosis
MALREFSSVKVGDQLPEKTYPLTRQDLVNYAGVSGDLNPIHWDDEIAKVVGLDTAIAHGMLTMGIGGGYVTSWVGDPGAVTEYNVRFTAVVPVPNDGKGAELVFNGRVKSVDPESKSVTIALTATTGGKKIFGRAIASAKLA

SEQ ID NO: 417 - protein, 166 aa, Mycobacterium tuberculosis
MALKTDIRGMIWRYPDYFIVGREQCREFARAVKCDHPAFFSEEAAADLGYDALVAPLTFVTILAKYVQLDFFRHVDVGMETMQIVQVDQRFVFHKPVLAGDKLWARMDIHSVDERFGADIVVTRNLCTNDDGELVMEAYTTLMGQQGDGSARLKWDKESGQVIRTA

SEQ ID NO: 418 - protein, 206 aa, Mycobacterium tuberculosis
MRSRFLPYATTPGRLLAQLISDITVAVWTTLWMLVGLAVHDAISIIGEAGRQIEIGSHGIAGNLAAAGQDAQRIPVVGDALSNPITAASQAALDIAGAGHNLDTTAGWLAVVLALAVAATPILAVAMPWLFLRLRFCRRKWTVTTLAATPAGRQLLALRALANRPPGKLAAVSTDPVGAWRREDPATMRALAALELRAAGIPLRGD

SEQ ID NO: 419 - protein, 129 aa, Mycobacterium tuberculosis
MSARDRVDPAKTRQVVLALADWLRDETLPAPDTDVLAAAVRLTARTLAALAPGASVEVRIPPFAAVQCISGPRHTRGTPPNVVQTDPRTWLLVATGLSGVAQARGSGALQLSGSRAGEIEAWLPLVDLG

SEQ ID NO: 420 - protein, 60 aa, Mycobacterium tuberculosis
MGRGRAKAKQTKVARELKYSSPQTDFQRLQRELSGTGTDRLDGDGPSDDDSWNDEDDWRR

SEQ ID NO: 421 - protein, 226 aa, Mycobacterium tuberculosis
VSSGAGSDATGAGGVHAAGSGDRAVAAAVERAKATAARNIPAFDDLPVPADTANLREGADLNNALLALLPLVGVWRGEGEGRGPDGDYRFGQQIVVSHDGGDYLNWESRSWRLTATGDYQEPGLREAGFWRFVADPYDPSESQAIELLLAHSAGYVELFYGRPRTQSSWELVTDALARSRSGVLVGGAKRLYGIVEGGDLAYVEERVDADGGLVPHLSARLSRFVG

SEQ ID NO: 422 - protein, 270 aa, Mycobacterium tuberculosis
MPMRKVLVGVTGAAIVVAVLIVGAVGADFGASIYAEYRLSTTVRKAANLRSDPFVAILRFPFIPQAMREHYAELEIKAFAVEHAGSGTATLEATMHSIDLSYASWLIRPDAKLPVGELESRIIIDSMHLGRYLGISDLMVAAPRQESNDATGGTTESGISGSRGLVFSGTPISANFAHRVSVLVDLSVASDDRATLVITPTAVVTGPDTADQPVPDDKRDAVLHAFASKLPNQKLPFGVVPNTVGARGSDVIIEGITRGVTISLDEFKQS

SEQ ID NO: 423 - protein, 315 aa, Mycobacterium tuberculosis
VTALDWRSALTADEQRSVRALVTATTAVDGVAPVGEQVLRELGQQRTEHLLVAGSRPGGPIIGYLNLSPPRGAGGAMAELVVHPQSRRRGIGTAMARAALAKTAGRNQFWAHGTLDPARATASALGLVGVRELIQMRRPLRDIPEPTIPDGVVIRTYAGTSDDAELLRVNNAAFAGHPEQGGWTAVQLAERRGEAWFDPDGLILAFGDSPRERPGRLLGFHWTKVHPDHPGLGEVYVLGVDPAAQRRGLGQMLTSIGIVSLARRLGGRKTLDPAVEPAVLLYVESDNVAAVRTYQSLGFTTYSVDTAYALAGTDN

SEQ ID NO: 424 - protein, 756 aa, Mycobacterium tuberculosis
MTEHTPDIPLGSWLAALPDERLTQLLELRPDLAQPPPGSIAALAARAQARQSVKAATDELDFLRLAVFDALLVLQADTAPVPIVRLLAVIGDRAAQADVLGALADLKQRALAWGETAVRVATDAGTALPWHPGQVTLEGSSRSGDQLADLIAGLDPAQRDVLDKLLQGSPVGRTRDAAPGAPSDRPVPRLLAMGLLRRIDAETVILPRHVGQVLRGEQPGPMELTAPDPVVSTTTPDDADAAAAGAVIDLLREVDVLLENLGATPVAELRSGGLGVREFKRLAKATGIDEPRLGLILEIAAAAGLIASGMPDPEPPHSDGPFWAPTVAADRFATMSPAERWHLLASAWLDLPGRPALIGTRGPDAKPYGALSDSLFSTAAPLDRRLLLGMLAELPAGAGVDASRASATLIWRRPRWARRLQPAPIADLLTEGHALGLVGRGAISTPARALLDEALEPATAPAAAVGVMARALPKPIDHFLVQADLTVVVPGPLQRELADDLTTVATVESAGTAMVYRVSEQSIRHALDVGKSRDWLQEFFANRSKTPVPQGLTYLIDDVARRHGQLRIGMAASFVRCEDPTLLAQVVAAPEADGLALRALAPTVAVSPAPISEVLVTLRGAGFAPAAEDSTGAVVDVRTRGARVPTPQRRRPYRPPPRPNSEALKAVVAVLREVTAAPFANVRVDPAVTMSLLQRAAKDQATLVISYLDAAGVATQRVVAPITLRGGQLVAFDSSSGRLRDFAIHRITLVVSAHDR

SEQ ID NO: 425 - protein, 93 aa, Mycobacterium tuberculosis
VCSVIADQRRPDQPCGVGGCKTCQNGFVADIAEGKARKTRYVDHGWPTTDPDDHAVSELVTDRTGALSPFGELTFPVPSDDLPYIHPVTVINR

SEQ ID NO: 426 - protein, 162 aa, Mycobacterium tuberculosis
VKRGVATLPVILVILLSVAAGAGAWLLVRGHGPQQPEISAYSHGHLTRVGPYLYCNVVDLDDCQTPQAQGELPVSERYPVQLSVPEVISRAPWRLLQVYQDPANTTSTLFRPDTRLAVTIPTVDPQRGRLTGIVVQLLTLVVDHSGELRDVPHAEWSVRLIF

SEQ ID NO: 427 - protein, 548 aa, Mycobacterium tuberculosis
MAPTPGRRTRNGSVNGHPGMANYPPDDANYRRSRRPPPMPSANRYLPPLGEQPEPERSRVPPRTTRAGERITVTRAAAMRSREMGSRMYLLVHRAATADGADKSGLTALTWPVMANFAVDSAMAVALANTLFFAAASGESKSRVALYLLITIAPFAVIAPLIGPALDRLQHGRRVALALSFGLRTALAVVLIMNYDGATGSFPSWVLYPCALAMMVFSKSFSVLRSAVTPRVMPPTIDLVRVNSRLTVFGLLGGTIAGGAIAAGVEFVCTHLFQLPGALFVVVAITIAGASLSMRIPRWVEVTSGEVPATLSYHRDRGRLRRRWPEEVKNLGGTLRQPLGRNIITSLWGNCTIKVMVGFLFLYPAFVAKAHEANGWVQLGMLGLIGAAAAVGNFAGNFTSARLQLGRPAVLVVRCTVLVTVLAIAAAVAGSLAATAIATLITAGSSAIAKASLDASLQHDLPEESRASGFGRSESTLQLAWVLGGAVGVLVYTELWVGFTAVSALLILGLAQTIVSFRGDSLIPGLGGNRPVMAEQETTRRGAAVAPQ

SEQ ID NO: 428 - protein, 262 aa, Mycobacterium tuberculosis
VTGPTEESAVATVADWPEGLAAVLRGAADQARAAVVEFSGPEAVGDYLGVSYEDGNAATHRFIAHLPGYQGWQWAVVVASYSGADHATISEVVLVPGPTALLAPDWVPWEQRVRPGDLSPGDLLAPAKDDPRLVPGYTASGDAQVDETAAEIGLGRRWVMSAWGRAQSAQRWHDGDYGPGSAMARSTKRVCRDCGFFLPLAGSLGAMFGVCGNELSADGHVVDRQYGCGAHSDTTAPAGGSTPIYEPYDDGVLDIIEKPAES

SEQ ID NO: 429 - protein, 91 aa, Mycobacterium tuberculosis
MSVENSQIREPPPLPPVLLEVWPVIAVGALAWLVAAVAAFVVPGLASWRPVTVAGLATGLLGTTIFVWQLAAARRGARGAQAGLETYLDPK

SEQ ID NO: 430 - protein, 253 aa, Mycobacterium tuberculosis
MRELKVVGLDADGKNIICQGAIPSEQFKLPVDDRLRAALRDDSVQPEQAQLDIEVTNVLSPKEIQARIRAGASVEQVAAASGSDIARIRRFAHPVLLERSRAAELATAAHPVLADGPAVLTMQETVAAALVARGLNPDSLTWDAWRNEDSRWTVQLAWKAGRSDNLAHFRFTPGAHGGTATAIDDTAHELINPTFNRPLRPLAPVAHLDFDEPEPAQPTLTVPSAQPVSNRRGKPAIPAWEDVLLGVRSGGRR

SEQ ID NO: 431 - protein, 340 aa, Mycobacterium tuberculosis
MDRTRIVRRWRRNMDVADDAEYVEMLATLSEGSVRRNFNPYTDIDWESPEFAVTDNDPRWILPATDPLGRHPWYQAQSRERQIEIGMWRQANVAKVGLHFESILIRGLMNYTFWMPNGSPEYRYCLHESVEECNHTMMFQEMVNRVGADVPGLPRRLRWVSPLVPLVAGPLPVAFFIGVLAGEEPIDHTQKNVLREGKSLHPIMERVMSIHVAEEARHISFAHEYLRKRLPRLTRMQRFWISLYFPLTMRSLCNAIVVPPKAFWEEFDIPREVKKELFFGSPESRKWLCDMFADARMLAHDTGLMNPIARLVWRLCKIDGKPSRYRSEPQRQHLAAAPAA

SEQ ID NO: 432 - protein, 59 aa, Mycobacterium tuberculosis
MGILDKVKNLLSQNADKVETVINKAGEFVDEQTQGNYSDAIHKLHDAASNVVGMSDQQS

SEQ ID NO: 433 - protein, 144 aa, Mycobacterium tuberculosis
MAKLSGSIDVPLPPEEAWMHASDLTRYREWLTIHKVWRSKLPEVLEKGTVVESYVEVKGMPNRIKWTIVRYKPPEGMTLNGDGVGGVKVKLIAKVAPKEHGSVVSFDVHLGGPALLGPIGMIVAAALRADIRESLQNFVTVFAG

SEQ ID NO: 434 - protein, 149 aa, Mycobacterium tuberculosis
MTRRLRPGWLVALSAAVIAASTWMPWLTTTVGGGGWVNAIGGTHGSLELPHGFGPGQLIVLLSSTLLVVGAMAGRGLSVKLSSIAALVVSLLIVALTVWYYKLNVNPPVSAEYGLYFGAAGGVCAVGCSLWAAVSAASPGRRRHREVVR

SEQ ID NO: 435 - protein, 105 aa, Mycobacterium tuberculosis
MRPEPPHHENAELAAMNLEMLESQPVPEIDTLREEIDRLDAEILALVKRRAEVSKAIGKARMASGGTRLVHSREMKVIERYSELGPDGKDLAILLLRLGRGRLGH

SEQ ID NO: 436 - protein, 303 aa, Mycobacterium tuberculosis
MTYSPGNPGYPQAQPAGSYGGVTPSFAHADEGASKLPMYLNIAVAVLGLAAYFASFGPMFTLSTELGGGDGAVSGDTGLPVGVALLAALLAGVALVPKAKSHVTVVAVLGVLGVFLMVSATFNKPSAYSTGWALWVVLAFIVFQAVAAVLALLVETGAITAPAPRPKFDPYGQYGRYGQYGQYGVQPGGYYGQQGAQQAAGLQSPGPQQSPQPPGYGSQYGGYSSSPSQSGSGYTAQPPAQPPAQSGSQQSHQGPSTPPTGFPSFSPPPPVSAGTGSQAGSAPVNYSNPSGGEQSSSPGGAPV

SEQ ID NO: 437 - protein, 455 aa, Mycobacterium tuberculosis
VNRVSASADDRAAGARPARDLVRVAFGPGVVALGIIAAVTLLQLLIANSDMTGAWGAIASMWLGVHLVPISIGGRALGVMPLLPVLLMVWATARSTARATSPQSSGLVVRWVVASALGGPLLMAAIALAVIHDASSVVTELQTPSALRAFTSVLVVHSVGAATGVWSRVGRRALAATALPDWLHDSMRAAAAGVLALLGLSGVVTAGSLVVHWATMQELYGITDSIFGQFSLTVLSVLYAPNVIVGTSAIAVGSSAHIGFATFSSFAVLGGDIPALPILAAAPTPPLGPAWVALLIVGASSGVAVGQQCARRALPFVAAMAKLLVAAVAGALVMAVLGYGGGGRLGNFGDVGVDEGALVLGVLFWFTFVGWVTVVIAGGISRRPKRLRPAPPVELDADESSPPVDMFDGAASEQPPASVAEDVPPSHDDIANGLKAPTADDEALPLSDEPPPRAD

SEQ ID NO: 438 - protein, 200 aa, Mycobacterium tuberculosis
MSNSAQRDARNSRDESARASDTDRIQIAQLLAYAAEQGRLQLTDYEDRLARAYAATTYQELDRLRADLPGAAIGPRRGGECNPAPSTLLLALLGGFERRGRWNVPKKLTTFTLWGSGVLDLRYADFTSTEVDIRAYSIMGAQTILLPPEVNVEIHGHRVMGGFDRKVVGEGTRGVPTVRIRGFSLWGDVGIKRKPRKPRK

SEQ ID NO: 439 - protein, 210 aa, Mycobacterium tuberculosis
MIHDLMLRWVVTGLFVLTAAECGLAIIAKRRPWTLIVNHGLHFAMAVAMAVMAWPWGARVPTTGPAVFFLLAAVWFGATAVVAVRGTATRGLYGYHGLMMLATAWMYAAMNPRLLPVRSCTEYATEPDGSMPAMDMTAMNMPPNSGSPIWFSAVNWIGTVGFAVAAVFWACRFVMERRQEATQSRLPGSIGQAMMAAGMAMLFFAMLFPV

SEQ ID NO: 440 - protein, 358 aa, Mycobacterium tuberculosis
MPSIPQSLLWISLVVLWLFVLVPMLISKRDAVRRTSDVALATRVLNGGAGARLLKRGGPAAGHRWGYLPPEGQGDDPDWKPEEDWRDDPVEDGFADVEHDIDEDQEADDARRRGAVVMKVAAPQTAGADEPDYLDVDVVEEDSEALPVGAGAAVGESADEADAEAADGVAGHADPEADPVEYEYEYEYVEDTCGLELEEDDQEAPPTVASGTSRRRRFDTKTAAAVSARKYTFRKRALIVMAVILVGSAAAAFELTPVAWWICGSATGVTVLYLAYLRRQTRIEEKVRRRRMQRIARARLGVENTRDREYDVVPSRLRRPGAVVLEIDDEDPIFTHLESAAPIRNYGWPRDLPRAVGQ

SEQ ID NO: 441 - protein, 333 aa, Mycobacterium tuberculosis
LDGIAELTGARVEDLAGMDVFQGCPAEGLVSLAASVQPLRAAAGQVLLRQGEPAVSFLLISSGSAEVSHVGDDGVAIIARALPGMIVGEIALLRDSPRSATVTTIEPLTGWTGGRGAFATMVHIPGVGERLLRTARQRLAAFVSPIPVRLADGTQLMLRPVLPGDRERTVHGHIQFSGETLYRRFMSARVPSPALMHYLSEVDYVDHFVWVVTDGSDPVADARFVRDETDPTVAEIAFTVADAYQGRGIGSFLIGALSVAARVDGVERFAARMLSDNVPMRTIMDRYGAVWQREDVGVITTMIDVPGPGELSLGREMVDQINRVARQVIEAVG

SEQ ID NO: 442 - protein, 205 aa, Mycobacterium tuberculosis
MCDKLGGVAIAVQGALFEHNERRQLGDGAFIDIRSGWLTGGEELLDALLSTVPWRAERRQMYDRVVDVPRLVSFHDLTIEDPPHPQLARMRRRLNDIYGGELGEPFTTAGLCYYRDGSDSVAWHGDTIGRGSTEDTMVAIVSLGATRVFALRPRGRGPSLRLPLAHGDLLVMGGSCQRTFEHAVPKTSAPTGPRVSIQFRPRDVR

SEQ ID NO: 443 - protein, 228 aa, Mycobacterium tuberculosis
MPEAKRPESKRRSPASRPGKAGDSVRGGRATKPSAKPSTPAPHASRKTTRTPHEHIVEPIKRAITESVEKRSEQRLGFTARRAAILAAVVCVLTLTIARPVRTYFAQRAEMEQLAATEAMLRRQIADLEEQQVKLADPAYIAAQARERLGFVMPGDIPFQVQLPSTPLAPPQPGSDAATATNNEPWYTALWHTIADDPHLPPAAPPAPEPGRPGPLPPASPNPEQPGG

SEQ ID NO: 444 - protein, 155 aa, Mycobacterium tuberculosis
VVTRQLGRAPRGVLAIAYRCPNGEPGVVKTAPRLPDGTPFPTLYYLTHPVLTAAASRLETTGLMREMNRRLGQDAELAAAYRRAHESYLSERDALEPLGTTVSAGGMPDRVKCLHVLIAHSLAKGPGLNPFGDEALALLAAEPRTAATLVAGQWR

SEQ ID NO: 445 - protein, 144 aa, Mycobacterium tuberculosis
MTHTPIPRPDARYGRPRLSRRARRRVAIALGVLVAAAGIVIAVIGYQRISTSAVTGSLVGYRLVDDETASVTISVTRSDPSRPVACIVRVRATNGSETGRRELLVPPSEATTVQVTTTVKSSQPPVMADVYGCGTEVPSYLRLP

SEQ ID NO: 446 - protein, 88 aa, Mycobacterium tuberculosis
VNQILLSVIAEGGPGNTGPDFGKASPVGLLVIVLLVIATLFLVRSMNQQLKKVPKSFDRDHPELDQAADEGTDRDGPARPPGPPHESG

SEQ ID NO: 447 - protein, 233 aa, Mycobacterium tuberculosis
MVGDCPRSRTVRWSWDTGHVTAEPQPTPRPAKPRLLQDGRDMFWSLAPLVVGCILLAGLVGMCSFQLGGTKRGPIPSYDAAQALRADAKTLGFPIRLPQLPGGWTPNSGGRGGIENGRADPATGQRRNAATSIVGFISPTGRYLSLTQSNADEDKLVGSIHPSMYPTGTVDVGGTRWVVYEGSDENGAVEPVWTTRLTGPGGATQLAITGAGSIDQFRTLASATQSQPPLPAR

SEQ ID NO: 448 - protein, 212 aa, Mycobacterium tuberculosis
MATAPYGVRLLVGAATVAVEETMKLPRTILMYPMTLASQAAHVVMRFQQGLAELVIKGDNTLETLFPPKDEKPEWATFDEDLPDALEGTSIPLLGLSDASEAKNDDRRSDGRFALYSVSDTPETTTASRSADRSTNPKTAKHPKSAAKPTVPTPAVAAELDYPALTLAQLRARLHTLDVPELEALLAYEQATKARAPFQTLLANRITRATAK

SEQ ID NO: 449 - protein, 327 aa, Mycobacterium tuberculosis
VSAQRARSAVQASHRSIHPHIPGVPWWAAILIAVTATAIGYAIDAGSGHKALTLVFTGCYIAGCVGAVLAVRQSDLFTALVQPPLILFCAVPGAYWLFHGGTIGKFKDLLINCGYSLIERFPLMLGTAAGVLLIGLVRWYLGTALFDSIARKLSSLMTGDSDDDGGRRSAQRPARTRSRHARPPSEDNREPIAERRSRRRPRPQNDPHPRRNAHERPAPRSSRFDSYRSYQPSEPSGPAEPVNRYERRGARYQPYARYEPTYEPQRRRARPSEPTNPTHHPISQVRYRGSATRDARRDNYREEQRFDRRDRSRAPRRPPAESWEYDV

SEQ ID NO: 450 - protein, 147 aa, Mycobacterium tuberculosis
MARQVFDDKLLAVISGNSIGVLATIKHDGRPQLSNVQYHFDPRKLLIQVSIAEPRAKTRNLRRDPRASILVDADDGWSYAVAEGTAQLTPPAAAPDDDTVEALIALYRNIAGEHSDWDDYRQAMVTDRRVLLTLPISHVYGLPPGMR

SEQ ID NO: 451 - protein, 371 aa, Mycobacterium tuberculosis
VRRLTNTEHRENTTVASTWSVCKGLAAVVITSAAAFALCPNAAADPATPQPNPTQQLPGLPALAQLSPIIQQAAMNPAQATQLLMAAASAFAGNPAVPTESKNVASSVNQFVAEPTNPDSAALGVPAPHGVALPEAIPVPHVPPLGAEPGVQAHLPTGIDPSHAAGPAPAVAPTVTPPVAAPPASAPAPAPDAAQPVAVPGPPPAPPAPRAAAPAPASAAPAPAAAPAPASGFGADAPPTQDFMYPSIGPNCVADGSNSIATALSVAGPAKIPLPGPGPGQTAYVFTAVGTPGPADVQRLPLNVTWVNLTTGKSGSATLRPRSDINPDGPTTLTVIADTGSGSIMSTIFGQVTTKDRQCQFMPTIGSTVVP

SEQ ID NO: 452 - protein, 227 aa, Mycobacterium tuberculosis
MPTIWTFVRAAAVLVGSSAALLTGGIAHADPAPAPAPAPNIPQQLISSAANAPQILQNLATALGATPPLSAPKVAEPAPAAPGITATFPGLTPAAPAAAAAPALTPSIPGVNAPIPGITPAAPALPVTAPAAAPTIPGVNAPIPGITAPAPAAAAVPASVPGVPSAKVDLPQLPYLPLQVPQQLSLPADLPALASGVIPAAPIAPTPPAPGAPALPPGPPSLLAALP

SEQ ID NO: 453 - protein, 94 aa, Mycobacterium tuberculosis
MAVLTDEQVDAALHDLNGWQRAGGVLRRSIKFPTFMAGIDAVRRVAERAEEVNHHPDIDIRWRTVTFALVTHAVGGITENDIAMAHDIDAMFGA

SEQ ID NO: 454 - protein, 146 aa, Mycobacterium tuberculosis
VGHRVDTLSDRQRANLTTGATDRAIRLVVLALLTVDGVVSALAGALLMPWYIGSAPFPISALISGLVNAALVWAAARWTTSSRVAALPLWAWLLTVAAMSFGGPGDDVILGGQGLLVYGALVFVVAGAVPPAWVLWRRRVQADGSG

SEQ ID NO: 455 - protein, 359 aa, Mycobacterium tuberculosis
MKRVIAGAFAVWLVGWAGGFGTAIAASEPAYPWAPGPPPSPSPVGDASTAKVVYALGGARMPGIPWYEYTNQAGSQYFPNAKHDLIDYPAGAAFSWWPTMLLPPGSHQDNMTVGVAVKDGTNSLDNAIHHGTDPAAAVGLSQGSLVLDQEQARLANDPTAPAPDKLQFTTFGDPTGRHAFGASFLARIFPPGSHIPIPFIEYTMPQQVDSQYDTNHVVTAYDGFSDFPDRPDNLLAVANAAIGAAIAHTPIGFTGPGDVPPQNIRTTVNSRGATTTTYLVPVNHLPLTLPLRYLGMSDAEVDQIDSVLQPQIDAAYARNDNWFTRPVSVDPVRGLDPLTAPGSIVEGARGLLGSPAFGG

SEQ ID NO: 456 - protein, 122 aa, Mycobacterium tuberculosis
VALVLVYLVVLVLVAIVLFAAASLLFGRGEQLPPLPRATTATTLPAFGVTRADVDAVKFTQVLRGYKTSEVDWVLERLGRELEALRSQLGAIHASSEDAEAESDASNPSRGETVVHYRSDPA

SEQ ID NO: 457 - protein, 75 aa, Mycobacterium tuberculosis
MLGADQARAGGPARIWREHSMAAMKPRTGDGPLEATKEGRGIVMRVPLEGGGRLVVELTPDEAAALGDELKGVTS

SEQ ID NO: 458 - protein, 154 aa, Mycobacterium tuberculosis
MADPGSVGHVFRRAFSWLPAQFASQSDAPVGAPRQFRSTEHLSIEAIAAFVDGELRMNAHLRAAHHLSLCAQCAAEVDDQSRARAALRDSHPIRIPSTLLGLLSEIPRCPPEGPSKGSSGGSSQGPPDGAAAGFGDRFADGDGGNRGRQSRVRR

SEQ ID NO: 459 - protein, 262 aa, Mycobacterium tuberculosis
MSARRIRSWKRFDNRSANAAEPDPQLAGTGGRPKVSTRALAQVIERSSRIQGPAAQAYVARLRRAHPGASPAKIVAKLEKRFLSVVTASGAAVGAAATLPGIGTLAAWFAAAGEVVVFLEATALFVLALASVHAIPLDHRERRRALVLAVLVGDNTTAVADLLGPGRTSGGWVSETMASLPLPAISSLNSRMLKYVVKRFALKRGALMFGKLVPMGIGAIIGAIGNRLVGKKLVRNARSAFGTPPARWPVTLHVLPTVRDAS

SEQ ID NO: 460 - protein, 1139 aa, Mycobacterium tuberculosis
VFVTGDSIVYSASDLAAAARCQYALLREFDAKLGRGPAVAVDDELMARAAVLGSAHEGRRLDQLRHEFGDAVAIIGRPAYTPAGLAAAADATRRAIANHAPVVYQAAMFDGRFVGFADFLIRDGHRYRVADTKLARSPTVTALLQLAAYADALVHSGVPVAADAELELGDGTIVRYRVGELIPVYRSQRALLQRLLDGHYTAGTAVRWDDERVQACFRCPQCTERLRASDDLLLVGGMRVRQRDKLLEAGITTIAELADHTAPVPGLTTNALGKLTAQAKLQIRQRDTGAPQFEIVDPRPLTLLPEPNPGDLFFDFEGDPLWTADGKQWGLEYLFGVLEAGRAGVFRPLWAHDRTAERQALTDFLAIVARRRRRHPNMHIYHYAPYEKTALLRLVGRYGIGEDDVDDLLRNGVLVDLYPLVRKSIRVGTDSFSLKALEPLYLGTQPRSGDVTTAADSINSYARYCELRAAGRIDEAATVLKEIEGYNHYDCRSTRALRDWLLMRAWEAGVTPIGAQPVPDADPIDDGDSLASVLSKFTGDAAAGERTPEQTAVALLAAARGYHRREDKPFWWAHFDRLNYPVDEWSDSTDVFLASEASVTVDWHMPPRARKPQRRVRLTGELARGDLNGNVFALYEPPAPPGMTDNPDRRAAGPAAVVETDDPTVPTEVVIVERTGSDGNTFQQLPFALAPGPPVPTTALRESIESTAAAVASGSPQLPSTALMDVLLRRPPRTRSGAALPRSSDPVTDIAAAALDLDSSYLAVHGPPGTGKTYTAARVIAELVTEHAWRIGVVAQSHATVENLLEGVISAGLDPGQVAKKPHDHTAGRWQSIDGSQYTEFIRDTAGCVIGGTAWDFANGNRVPKASLDLLVIDEAGQFCLANTIAVAPAATNLLLLGDPQQLPQVSQGTHPEPVDTSALSWLVDGQHTLPDERGYFLDRSYRMHPAVCAAVSALSYEGRLCSHTERTAVRRLDGYPPGVHTRGVHHKGNSIESPEEAEAILAELRQLLGSPWTDEHGTRPLAASDVLVLAPYNAQVALVRRRLASAGLGGADGVRVGTVDKFQGGQAPVVFISMTASSADDVPRGISFLLNRNRLNVAVSRAQYAAVIVRSELLTQYLPATPDGLVDLGAFLGLTSTS

SEQ ID NO: 461 - protein, 299 aa, Mycobacterium tuberculosis
MNIAAESSAKPVWGPPNFCAAAARMQDVRVLMHPKTGRAFRSPVEPGSGWPGDPATPQTPVAADAAQVSALAGGAGSICELNALISVCRACPRLVSWREEVAVVKRRAFADQPYWGRPVPGWGSKRPRLLILGLAPAAHGANRTGRMFTGDRSGDQLYAALHRAGLVNSPVSVDAADGLRANRIRITAPVRCAPPGNSPTPAERLTCSPWLNAEWRLVSDHIRAIVALGGFAWQVALRLAGASGTPKPRFGHGVVTELGAGVRLLGCYHPSQQNMFTGRLTPTMLDDIFREAKKLAGIE

SEQ ID NO: 462 - protein, 158 aa, Mycobacterium tuberculosis
MRHAKSAYPDGIADHDRPLAPRGIREAGLAGGWLRANLPAVDAVLCSTATRARQTLAHTGIDAPARYAERLYGAAPGTVIEEINRVGDNVTTLLVVGHEPTTSALAIVLASISGTDAAVAERISEKFPTSGIAVLRVAGHWADVEPGCAALVGFHVPR

SEQ ID NO: 463 - protein, 417 aa, Mycobacterium tuberculosis
VSPRPGPAGRGPAPCRCADLHSLCVDSHALRRDGMRFLHTADWQLGMTRHFLAGDAQPRYSAARRDAVAGLKALAADVGAEFVVVAGDVFEHNQLAPQIVGQSLEAMRVIGLPVYLLPGNHDPLDASSVYTSTLFRAERPDNVVVLDRAGVHEVRPGVQIVAAPWRSKAPTTDPVAEVLAGLPTDAAIRLLVAHGGVDALDPDHDKPSLIRLAALDDALTRQAIHYVALGDKHSLTQVGSSGRVWYSGAPEVTNFDDVEPDPGHVLVVDIDESDPRHPVTVDARRIGRWRFVTLHHQVDTSRDIADLDLNLDLMTDKDRTVVRLALTGSLTVTDRAALDTCLDKYARLFAWLGLWERHTDLAVIPVDAEFTDLGIGGFAAAAVDELVATARGGDDESAVDAQAALALLLRLADRGAA

SEQ ID NO: 464 - protein, 875 aa, Mycobacterium tuberculosis
VKLHRLALTNYRGIAHRDVEFPDHGVVVVCGANEIGKSSMVEALDLLLEYKDRSTKKEVKQVKPTNADVGSEVIAEISSGPYRFVYRKRFHKRCETELTVLAPRREQLTGDEAHERVRTMLAETVDTELWHAQRVLQAASTAAVDLSGCDALSRALDLAAGDDAALSGTESLLIERIEAEYARYFTPTGRPTGEWSAAVSRLAAAEAAVADCAAAVAEVDDGVRRHTELTEQVAELSQQLLAHQLRLEAARVAAEKIAAITDDAREAKLIATAAAATSGASTAAHAGRLGLLTEIDTRTAAVVAAEAKARQAADEQATARAEAEACDAALTEATQVLTAVRLRAESARRTLDQLADCEEADRLAARLARIDDIEGDRDRVCAELSAVTLTEELLSRIERAAAAVDRGGAQLASISAAVEFTAAVDIELGVGDQRVSLSAGQSWSVTATGPTEVKVPGVLTARIVPGATALDFQAKYAAAQQELADALAAGEVADLAAARSADLCRRELLSRRDQLTATLAGLCGDEQVDQLRSRLEQLCAGQPAELDLVSTDTATARAELDAVEAARIAAEKDCETRRQIAAGAARRLAETSTRATVLQNAAAAESAELGAAMTRLACERASVGDDELAAKAEADLRVLQTAEQRVIDLADELAATAPDAVAAELAEAADAVELLRERHDEAIRALHEVGVELSVFGTQGRKGKLDAAETEREHAASHHARVGRRARAARLLRSVMARHRDTTRLRYVEPYRAELHRLGRPVFGPSFEVEVDTDLRIRSRTLDDRTVPYECLSGGAKEQLGILARLAGAALVAKEDAVPVLIDDALGFTDPERLAKMGEVFDTIGADGQVIVLTCSPTRYGGVKGAHRIDLDAIQ

SEQ ID NO: 465 - protein, 161 aa, Mycobacterium tuberculosis
VTTPAQDAPLVFPSVAFRPVRLFFINVGLAAVAMLVAGVFGHLTVGMFLGLGLLLGLLNALLVRRSAESITAKEHPLKRSMALNSASRLAIITILGLIIAYIFRPAGLGVVFGLAFFQVLLVATTALPVLKKLRTATEEPVATYSSNGQTGGSEGRSASDD

SEQ ID NO: 466 - protein, 147 aa, Mycobacterium tuberculosis
MSAPMIGMVVLVVVLGLAVLALSYRLWKLRQGGTAGIMRDIPAVGGHGWRHGVIRYRGGEAAFYRLSSLRLWPDRRLSRRGVEIISRRAPRGDEFDIMTDEIVVVELCDSTQDRRVGYEIALDRGALTAFLSWLESRPSPRARRRSM

SEQ ID NO: 467 - protein, 304 aa, Mycobacterium tuberculosis
VTRPRPPLGPAMAGAVDLSGIKQRAQQNAAASTDADRALSTPSGVTEITEANFEDEVIVRSDEVPVVVLLWSPRSEVCVDLLDTLSGLAAAAKGKWSLASVNVDVAPRVAQIFGVQAVPTVVALAAGQPISSFQGLQPADQLSRWVDSLLSATAGKLKGAASSEESTEVDPAVAQARQQLEDGDFVAARKSYQAILDANPGSVEAKAAIRQIEFLIRATAQRPDAVSVADSLSDDIDAAFAAADVQVLNQDVSAAFERLIALVRRTSGEERTRVRTRLIELFELFDPADPEVVAGRRNLANALY

SEQ ID NO: 468 - protein, 218 aa, Mycobacterium tuberculosis
MPPVCGRRCSRTGEIRGYSGSIVRRWKRVETRDGPRFRSSLAPHEAALLKNLAGAMIGLLDDRDSSSPSDELEEITGIKTGHAQRPGDPTLRRLLPDFYRPDDLDDDDPTAVDGSESFNAALRSLHEPEIIDAKRVAAQQLLDTVPDNGGRLELTESDANAWIAAVNDLRLALGVMLEIGPRGPERLPGNHPLAAHFNVYQWLTVLQEYLVLVLMGSR

SEQ ID NO: 469 - protein, 120 aa, Mycobacterium tuberculosis
MTAPETPAAQHAEPAIAVERIRTALLGYRIMAWTTGLWLIALCYEIVVRYVVKVDNPPTWIGVVHGWVYFTYLLLTLNLAVKVRWPLGKTAGVLLAGTIPLLGIVVEHFQTKEIKARFGL

SEQ ID NO: 470 - protein, 126 aa, Mycobacterium tuberculosis
VSTTRRRRPALIALVIIATCGCLALGWWQWTRFQSTSGTFQNLGYALQWPLFAWFCVYAYRNFVRYEETPPQPPTGGAAAEIPAGLLPERPKPAQQPPDDPVLREYNAYLAELAKDDARKQNRTTA

SEQ ID NO: 471 - protein, 110 aa, Mycobacterium tuberculosis
VSISQSDASLAAVPAVDQFDPSSGASGGYDTPLGITNPPIDELLDRVSSKYALVIYAAKRARQINDYYNQLGEGILEYVGPLVEPGLQEKPLSIALREIHADLLEHTEGE

SEQ ID NO: 472 - protein, 154 aa, Mycobacterium tuberculosis
VTAAPNDWDVVLRPHWTPLFAYAAAFLIAVAHVAGGLLLKVGSSGVVFQTADQVAMGALGLVLAGAVLLFARPRLRVGSAGLSVRNLLGDRIVGWSEVIGVSFPGGSRWARIDLADDEYIPVMAIQAVDKDRAVAAMDTVRSLLARYRPDLCAR

SEQ ID NO: 473 - protein, 186 aa, Mycobacterium tuberculosis
MTGPYFPQTIPFLPSYIPQDVDMTAVKAEVAALGVSAPPAATPGLLEVVQHARDEGIDLKIVLLDHNPPNDTPLRDIATVVGADYSDATVLVLSPNYVGSYSTQYPRVTLEAGEDHSKTGNPVQSAQNFVHELSTPEFPWSALTIVLLIGVLAAAVGARLMQLRGRRSATSTDAAPGAGDDLNQGV

SEQ ID NO: 474 - protein, 79 aa, Mycobacterium tuberculosis
MVEIVAGKQRAPVAAGVYNVYTGELADTATPTAARMGLEPPRFCAQCGRRMVVQVRPDGWWARCSRHGQVDSADLATQR

SEQ ID NO: 475 - protein, 221 aa, Mycobacterium tuberculosis
VTEPPGFGGPSEPSGAPRTSRTRAVLFVMLGLSATGVLVGGLWAWIAPPIHAVVAITRAGERVHEYLGSESQNFFIAPFMLLGLLSVLAVVASALMWQWREHRGPQMVAGLSIGLTTAAAIAAGVGALVVRLRYGALDFDTVPLSRGDHALTYVTQAPPVFFARRPLQIALTLMWPAGIASLVYALLAAGTARDDLGGYPAVDPSSNARTEALETPQAPVS

SEQ ID NO: 476 - protein, 235 aa, Mycobacterium tuberculosis
VAANAGSVRPNRRARPMIGIAQLLLVVAAGALWMAARLPWVVIGSFDELGPPKEVTLTGASWSTALLPLALLMLAAAVAALAVRGWPLRALAVLLAAASFAVGYLGISLWVVPDVAARGADLAHVPVVTLVGSARHYWGAVAAVLAAVCALLAAVFLMSSAAIRGSAGEDMARYAAPRARRSIARRQHSNAAGRAAPQDDGPDMGPRMSERMIWEALDEGRDPTDREQESDTEGR

SEQ ID NO: 477 - protein, 556 aa, Mycobacterium tuberculosis
MHASRPGAPPHAGLPSRRTAGDQDHRADPKVTRIMSASTLEQPAAAHVDELVARMRGRLLDPLAIAVLAAVISGAWASRPSLWFDEGATISASASRTLPELWSLLGHIDAVHGLYYLLMHGWFAIFPPTELWSRLPSCLAIGAAAAGVVVFAKQFSGRTTAVCAGAVFAILPRVTWAGIEARSSALSVAAAVWLTVLLVAAVRCNTQRRWLLYALVLMLSILVSINLALLVPAYATMVPLLASGKSRKSPVIWWTVVTAAALGAMTPFILFAHGQVWQVGWIAGLNRNIILDVIHRQYFDHSVPFAILAGLIVAAGIAAHLAGARGPGGDTHRLVLVSAAWIVVPTAVVLIYSATVEPIYYPRYLILTAPAAAVILAVCVVTIARKPWLIAGVVFLLAAAAFPNYFFTQRGPYAKEGWDYSQVADVISAHAKPGDCLLVDNTAGWRPGPIRALLATRPAAFRSLIDVERGTYGPKVGTLWDGHVAVWLTTAKIDKCPTLWTIANRDKSLPDHQVGEMLSPGTGFGRTPVYRFPSYLGFRIVERWQFHYSQVVKSTR

SEQ ID NO: 478 - protein, 316 aa, Mycobacterium tuberculosis
LAGSARTTYPCHVEVGPQDSESGAPDETATAMASPVPRQRSALRWLRTVNRSPGLVSFIHRARRLLPGDPEFGDPLSTAGEGGPRAAARAADRLLRDRDAASREVGLSVLQVWQALTEAVSRRPANPEVTLVFTDLVGFSTWSLHAGDDATLTLLRQVARAVESPLLDAGGHIVKRLGDGIMAVFRNPTVALRAVLVAQDAVKSLEVQGYTPRMRIGIHTGRPQRLAADWLGVDVNIAARVMERATKGGIMISQPTLDLIPQSELDALGVVARRVRKPVFASKPTGIPPDLAIYRIKTVSESTAADNFDEMSPDAQ

SEQ ID NO: 479 - protein, 58 aa, Mycobacterium tuberculosis
MTIDPDQIRAEIDALLASLPDPADAENGPSLAELEGIARRLSEAHEVLLAALESAEKG

SEQ ID NO: 480 - protein, 393 aa, Mycobacterium tuberculosis
MRMSALLSRNTSRPGLIGIARVDRNIDRLLRRVCPGDIVVLDVLDLDRITADALVEAEIAAVVNASSSVSGRYPNLGPEVLVTNGVTLIDETGPEIFKKVKDGAKVRLYEGGVYAGDRRLIRGTERTDHDIADLMREAKSGLVAHLEAFAGNTIEFIRSESPLLIDGIGIPDVDVDLRRRHVVIVADEPSGPDDLKSLKPFIKEYQPVLVGVGTGADVLRKAGYRPQLIVGDPDQISTEVLKCGAQVVLPADADGHAPGLERIQDLGVGAMTFPAAGSATDLALLLADHHGAALLVTAGHAANIETFFDRTRVQSNPSTFLTRLRVGEKLVDAKAVATLYRNHISGGAIALLALTMLIAIIVALWVSRTDGVVLHWIIDYWNRFSLWVQHLVS

SEQ ID NO: 481 - protein, 314 aa, Mycobacterium tuberculosis
MISLRQHAVSLAAVFLALAMGVVLGSGFFSDTLLSSLRSEKRDLYTQIDRLTDQRDALREKLSAADNFDIQVGSRIVHDALVGKSVVIFRTPDAHDDDIAAVSKIVGQAGGAVTATVSLTQEFVEANSAEKLRSVVNSSILPAGSQLSTKLVDQGSQAGDLLGIALLSNADPAAPTVEQAQRDTVLAALRETGFITYQPRDRIGTANATVVVTGGALSTDAGNQGVSVARFAAALAPRGSGTLLAGRDGSANRPAAVAVTRADADMAAEISTVDDIDAEPGRITVILALHDLINGGHVGHYGTGHGAMSVTVSQ

SEQ ID NO: 482 - protein, 563 aa, Mycobacterium tuberculosis
MYRYQVRVQQRRSEMNRWVATRSRRHTYQWITDHKSPRDHYRHISELRTSIATSSPGRCDMSPIPRIVSVSLAWAAAIGLMVPIGLAPPAMAAPCSGDAANAPPPPSAIVTDPGATALGPVRPGHGPIPTGRKPRGANDRAPLPKLGPLISALLNPGARNAAPLQQQALVPRANPGPNPAPNPPATGPQPPNATQLTPNPAPAPDPAPAAAPDPGATLAGATTSLAEWVTGPDSPNKTLERFGISGTDLGIPWDNGDPANRQVLMIFGDTFGYCAVDGHQWRYNTLFRSQDRDLGNGVHVTSGDASNRYSGSPVRQPGFSKQLINSIKWARDETGIIPTAGIAVGKTQYVNFMSIRNWGRDGEWTTNYSGIAVSKDNGQTWGVFPGTIRASGPDSGGKARFVPGNENFQMGAYLKSNDGYLYSFGTPPGRGGSAYLARVPQRFVPDLTKYQYWNGDSNSWVPNKPDAATPVIPGPVGEMSVQYNTYLKQYLALYTNGMNDVVARTAPAPQGPWSAEQMLVSSWQMPGGIYAPMMHPWSTGKDVYFNLSLWSAYNVMLMHTVLP

SEQ ID NO: 483 - protein, 506 aa, Mycobacterium tuberculosis
VAEESRGQRGSGYGLGLSTRTQVTGYQFLARRTAMALTRWRVRMEIEPGRRQTLAVVASVSAALVICLGALLWSFISPSGQLNESPIIADRDSGALYVRVGDRLYPALNLASARLITGRPDNPHLVRSSQIATMPRGPLVGIPGAPSSFSPKSPPASSWLVCDTVATSSSIGSLQGVTVTVIDGTPDLTGHRQILSGSDAVVLRYGGDAWVIREGRRSRIEPTNRAVLLPLGLTPEQVSQARPMSRALFDALPVGPELLVPEVPNAGGPATFPGAPGPIGTVIVTPQISGPQQYSLVLGDGVQTLPPLVAQILQNAGSAGNTKPLTVEPSTLAKMPVVNRLDLSAYPDNPLEVVDIREHPSTCWWWERTAGENRARVRVVSGPTIPVAATEMNKVVSLVKADTSGRQADQVYFGPDHANFVAVTGNNPGAQTSESLWWVTDAGARFGVEDSKEARDALGLTLTPSLAPWVALRLLPQGPTLSRADALVEHDTLPMDMTPAELVVPK

SEQ ID NO: 484 - protein, 300 aa, Mycobacterium tuberculosis
MDQQSTRTDITVNVDGFWMLQALLDIRHVAPELRCRPYVSTDSNDWLNEHPGMAVMREQGIVVNDAVNEQVAARMKVLAAPDLEVVALLSRGKLLYGVIDDENQPPGSRDIPDNEFRVVLARRGQHWVSAVRVGNDITVDDVTVSDSASIAALVMDGLESIHHADPAAINAVNVPMEEMLEATKSWQESGFNVFSGGDLRRMGISAATVAALGQALSDPAAEVAVYARQYRDDAKGPSASVLSLKDGSGGRIALYQQARTAGSGEAWLAICPATPQLVQVGVKTVLDTLPYGEWKTHSRV

SEQ ID NO: 485 - protein, 406 aa, Mycobacterium tuberculosis
MKAQRSFGLALSWPRVTAVFLVDVLILAVASHCPDSWQADHHVAWWVGVGVAAVVTLLSVVSYHGITVISGLATWVRDWSADPGTTLGAGCTPAIDHQRRFGRDTVGVREYNGRLVSVIEVTCGESGPSGRHWHRKSPVPMLPVVAVADGLRQFDIHLDGIDIVSVLVRGGVDAAKASASLQEWEPQGWKSEERAGDRTVADRRRTWLVLRMNPQRNVAAVACRDSLASTLVAATERLVQDLDGQSCAARPVTADELTEVDSAVLADLEPTWSRPGWRHLKHFNGYATSFWVTPSDITSETLDELCLPDSPEVGTTVVTVRLTTRVGSPALSAWVRYHSDTRLPKEVAAGLNRLTGRQLAAVRASLPAPTHRPLLVIPSRNLRDHDELVLPVGQELEHATSSFVGQ

SEQ ID NO: 486 - protein, 247 aa, Mycobacterium tuberculosis
VSAPDSPALAGMSIGAVLDLLRPDFPDVTISKIRFLEAEGLVTPRRASSGYRRFTAYDCARLRFILTAQRDHYLPLKVIRAQLDAQPDGELPPFGSPYVLPRLVPVAGDSAGGVGSDTASVSLTGIRLSREDLLERSEVADELLTALLKAGVITTGPGGFFDEHAVVILQCARALAEYGVEPRHLRAFRSAADRQSDLIAQIAGPLVKAGKAGARDRADDLAREVAALAITLHTSLIKSAVRDVLHR

SEQ ID NO: 487 - protein, 225 aa, Mycobacterium tuberculosis
VTQLVTRARSARGSTLGEQPRQDQLDFADHTGTAGDGNDGAAAASGPVQPGLFPDDSVPDELVGYRGPSACQIAGITYRQLDYWARTSLVVPSIRSAAGSGSQRLYSFKDILVLKIVKRLLDTGISLHNIRVAVDHLRQRGVQDLANITLFSDGTTVYECTSAEEVVDLLQGGQGVFGIAVSGAMRELTGVIADFHGERADGGESIAAPEDELASRRKHRDRKIG

SEQ ID NO: 488 - protein, 677 aa, Mycobacterium tuberculosis
MGRHSKPDPEDSVDDLSDGHAAEQQHWEDISGSYDYPGVDQPDDGPLSSEGHYSAVGGYSASGSEDYPDIPPRPDWEPTGAEPIAAAPPPLFRFGHRGPGDWQAGHRSADGRRGVSIGVIVALVAVVVMVAGVILWRFFGDALSNRSHTAAARCVGGKDTVAVIADPSIADQVKESADSYNASAGPVGDRCVAVAVTSAGSDAVINGFIGKWPTELGGQPGLWIPSSSISAARLTGAAGSQAISDSRSLVISPVLLAVRPELQQALANQNWAALPGLQTNPNSLSGLDLPAWGSLRLAMPSSGNGDAAYLAGEAVAAASAPAGAPATAGIGAVRTLMGARPKLADDSLTAAMDTLLKPGDVATAPVHAVVTTEQQLFQRGQSLSDAENTLGSWLPPGPAAVADYPTVLLSGAWLSQEQTSAASAFARYLHKPEQLAKLARAGFRVSDVKPPSSPVTSFPALPSTLSVGDDSMRATLADTMVTASAGVAATIMLDQSMPNDEGGNSRLSNVVAALENRIKAMPPSSVVGLWTFDGREGRTEVPAGPLADPVNGQPRPAALTAALGKQYSSGGGAVSFTTLRLIYQEMLANYRVGQANSVLVITAGPHTDQTLDGPGLQDFIRKSADPAKPIAVNIIDFGADPDRATWEAVAQLSGGSYQNLETSASPDLATAVNIFLS

SEQ ID NO: 489 - protein, 316 aa, Mycobacterium tuberculosis
VSALAFTILAVLLAGPTPALLARATWPLRAPRAAMVLWQAIALAAVLSSFSAGIAIASRLLMPGPDGRPTTSFVGAAGRLGWPLWAAYITVFALTVLVGARLAVAVVRVATATRRRRAHHRMVVDLVGVGHNGALAQPCARARDLRVLDVAQPLAYCLPGVRSRVVVSEGTLTALADAEVAAILTHERAHLRARHDLVLEAFTAVHAAFPRLVRSANALGAVQLLVELLADDAAVRAAGRTPLARALVACASGRAPSGALAVGGPSTVLRVRRLSGRGNSAVLSAAAYLAAAAVLVVPTVALAVPWLTQLQRLFIA

SEQ ID NO: 490 - protein, 138 aa, Mycobacterium tuberculosis
MAKLTRLGDLERAVMDHLWSRTEPQTVRQVHEALSARRDLAYTTVMTVLQRLAKKNLVLQIRDDRAHRYAPVHGRDELVAGLMVDALAQAEDSGSRQAALVHFVERVGADEADALRRALAELEAGHGNRPPAGAATET

SEQ ID NO: 491 - protein, 101 aa, Mycobacterium tuberculosis
MDITATTEFSAMNLDGKTGIGWLGYIVIGGIAGWLASKIVKGGGSGILMNVVIGVVGAFGAGLVLNALGVDVNHGGYWFTFFVALGGAVVLLWIVGMVRKT

SEQ ID NO: 492 - protein, 129 aa, Mycobacterium tuberculosis
LNAAMNLKREFVHRVQRFVVNPIGRQLPMTMLETIGRKTGQPRRTAVGGRVVDNQFWMVSEHGEHSDYVYNIKANPAVRVRIGGRWRSGTAYLLPDDDPRQRLRGLPRLNSAGVRAMGTDLLTIRVDLD

SEQ ID NO: 493 - protein, 153 aa, Mycobacterium tuberculosis
MCLDQVMEGSATVHMAAPPDKIWTLIADVRNTGRFSPETFEAEWLDGATGPALGARFRGHVRRNGIGPVYWTVCEPGREFGFAVLLGDRPVNNWHYRLTPTADGTEVTESFRLPPSVLTTVYYRVFGGWLRQRRNIRDMTKTLQRIKDLVEAG

SEQ ID NO: 494 - protein, 135 aa, Mycobacterium tuberculosis
MIRELVTTAAITGAAIGGAPVAGADPQRYDGDVPGMNYDASLGAPCSSWERFIFGRGPSGQAEACHFPPPNQFPPAETGYWVISYPLYGVQQVGAPCPKPQAAAQSPDGLPMLCLGARGWQPGWFTGAGFFPPEP

SEQ ID NO: 495 - protein, 72 aa, Mycobacterium tuberculosis
MSFNPKDAVDAVRDIAANAVEKASDIVENAGHIIRGDIAGGASGIVKDSIDIATHAVDRTKEVFTGKTDDEG

SEQ ID NO: 496 - protein, 156 aa, Mycobacterium tuberculosis
MRLKPAPSPAAAFAVAGLILAGWAGSVGLAGADPEPAPTPKTAIDSDGTYAVGIDIAPGTYSSAGPVGDGTCYWKRMGNPDGALIDNALSKKPQVVTIEPTDKAFKTHGCQPWQNTGSEGAAPAGVPGPEAGAQLQNQLGILNGLLGPTGGRVPQP

SEQ ID NO: 497 - protein, 154 aa, Mycobacterium tuberculosis
MSGRKFSFEVTKTSSAPAATLFRLVTDGGNWATWAKPIVAQSSWARRGDPAPGGIGAIRKLGMWPVFVQEETVEYEQDRRHVYKLVGARTPVQDYFGEVVLTPNASGGTDLRWSGSFTEKVRGTGPVMRAALGGAVRFFAGQLVKAAEREAVRR

SEQ ID NO: 498 - protein, 135 aa, Mycobacterium tuberculosis
VRWIVDGMNVIGSRPDGWWRDRHRAMVMLVERLEGWAITKARGDDVTVVFERPPSTAIPSSVVEVAHAPKAAANSADDEIVRLVRSGAQPQEIRVVTSDKALTDRVRDLGAAVYPAERFRDLIDPRGSNAARRTQ

SEQ ID NO: 499 - protein, 111 aa, Mycobacterium tuberculosis
MADRVLRGSRLGAVSYETDRNHDLAPRQIARYRTDNGEEFEVPFADDAEIPGTWLCRNGMEGTLIEGDLPEPKKVKPPRTHWDMLLERRSIEELEELLKERLELIRSRRRG

SEQ ID NO: 500 - protein, 237 aa, Mycobacterium tuberculosis
MTTIEIDAPAGPIDALLGLPPGQGPWPGVVVVHDAVGYVPDNKLISERIARAGYVVLTPNMYARGGRARCITRVFRELLTKRGRALDDILAARDHLLAMPECSGRVGIVGFCMGGQFALVLSPRGFGATAPFYGTPLPRHLSETLNGACPIVASFGTRDPLGIGAANRLRKVTAAKNIPADIKSYPGAGHSFANKLPGQPLVRIAGFGYNEAATEDAWRRVFEFFGQHLRAGSPGEP

SEQ ID NO: 501 - protein, 134 aa, Mycobacterium tuberculosis
VTPTFSDLAEAQYLLLTTFTKDGRPKPVPIWAALDTDRGDRLLVITEKKSWKVKRIRNTPRVTLATCTLRGRPTSEAVEATAAILDESQTGAVYDAIVKRYGIQGKLFTFVSKLRGGMRNNIGLELKVAESETG

SEQ ID NO: 502 - protein, 244 aa, Mycobacterium tuberculosis
MSGPQGSDPRQPWQPPGQGADHSSDPTVAAGYPWQQQPTQEATWQAPAYTPQYQQPADPAYPQQYPQPTPGYAQPEQFGAQPTQLGVPGQYGQYQQPGQYGQPGQYGQPGQYAPPGQYPGQYGPYGQSGQGSKRSVAVIGGVIAVMAVLFIGAVLILGFWAPGFFVTTKLDVIKAQAGVQQVLTDETTGYGAKNVKDVKCNNGSDPTVKKGATFECTVSIDGTSKRVTVTFQDNKGTYEVGRPQ

SEQ ID NO: 503 - protein, 64 aa, Mycobacterium tuberculosis
MAQEQTKRGGGGGDDDDIAGSTAAGQERREKLTEETDDLLDEIDDVLEENAEDFVRAYVQKGGQ

SEQ ID NO: 504 - protein, 292 aa, Mycobacterium tuberculosis
VTPSEGNAPLPELHNTVVVAAFEGWNDAGDAAGDAVAHLAASWQALPIVEIDDEAYYDYQVNRPVIRQVDGVTRELQWPAMRISHCRPPGSDRDVVLMCGVEPNMRWRTFCDELLAVIDKLNVDTVVILGALLADTPHTRPVPVSGAAYSAASARQFGLQETRYEGPTGIAGVFQSACVGAGIPAVTFWAAVPHYVSHPPNPKATIALLRRVEDVLDVEVPLADLPAQAEAWEREITETIAEDHELAEYVQTLEQHGDAAVDMNEALGNIDGDALAAEFERYLRRRRPGFGR

SEQ ID NO: 505 - protein, 262 aa, Mycobacterium tuberculosis
VLADGELTVLGRIRSASNATFLCESTLGLRSLHCVYKPVSGERPLWDFPDGTLAGRELSAYLVSTQLGWNLVPHTIIRDGPAGIGMLQLWVQQPGDAVDSDPLPGPDLVDLFPAHRPRPGYLPVLRAYDYAGDEVVLMHADDIRLRRMAVFDVLINNADRKGGHILCGIDGQVYGVDHGLCLHVENKLRTVLWGWAGKPIDDQILQAVAGLADALGGPLAEALAGRIAAAEIGALRRRAQSLLDQPVMPGPNGHRPIPWPAF

SEQ ID NO: 506 - protein, 195 aa, Mycobacterium tuberculosis
MARAIHVFRTPDRFVAGTVGQPGNRTFYLQAVHDSRVVSVVLEKQQVAVLAERIGALLFEVNRRFGTPVPPEPTEIDDLSPLIMPVDAEFRVGTMGLGWDSEAQSVVVELLAVTDAEFDASVVLDDTEEGPDAVRVFLTPESARQFATRSYRVISAGRPPCPLCDEPLDPEGHICARTNGYRRDVLLGSGDDPAG

SEQ ID NO: 507 - protein, 137 aa, Mycobacterium tuberculosis
MRNMKSTSHESESGKLLSISSCRPREMVLQRYSLGMTVTADRHLADKREEFAVEDISTGIFASGYGQVGDGRSFSFHIEHRSLVVEIYRPRVAGPVPQAEDVVAMAVRGLVDIDLTDERSLAAAVRDSVASAAPVSR

SEQ ID NO: 508 - protein, 118 aa, Mycobacterium tuberculosis
MLIIALVLALIGLLALVFAVVTSNQLVAWVCIGASVLGVALLIVDALRERQQGGADEADGAGETGVAEEADVDYPEEAPEESQAVDAGVIGSEEPSEEASEATEESAVSADRSDDSAK

SEQ ID NO: 509 - protein, 96 aa, Mycobacterium tuberculosis
LVVFFQILGFALFIFWLLLIARVVVEFIRSFSRDWRPTGVTVVILEIIMSITDPPVKVLRRLIPQLTIGAVRFDLSIMVLLLVAFIGMQLAFGAAA

SEQ ID NO: 510 - protein, 241 aa, Mycobacterium tuberculosis
VNSHCSHTFITDNRSPRARRGHAMSTLHKVKAYFGMAPMEDYDDEYYDDRAPSRGYARPRFDDDYGRYDGRDYDDARSDSRGDLRGEPADYPPPGYRGGYADEPRFRPREFDRAEMTRPRFGSWLRNSTRGALAMDPRRMAMMFEDGHPLSKITTLRPKDYSEARTIGERFRDGSPVIMDLVSMDNADAKRLVDFAAGLAFALRGSFDKVATKVFLLSPADVDVSPEERRRIAETGFYAYQ

SEQ ID NO: 511 - protein, 384 aa, Mycobacterium tuberculosis
MRAKREAPKSRSSDRRRRADSPAAATRRTTTNSAPSRRIRSRAGKTSAPGRQARVSRPGPQTSPMLSPFDRPAPAKNTSQAKARAKARKAKAPKLVRPTPMERLAARLTSIDLRPRTLANKVPFVVLVIGSLGVGLGLTLWLSTDAAERSYQLSNARERTRMLQQHKEALERDVREAASAPALAEAARRQGMIPTRDTAHLVQDPDGNWVVVGTPKPADGVPPPPLNTKLPEDPPPPPKPAAVPLEVPVRVTPGPDDPAPPARSGPEVLVRTPDGTATLGGATHLPTQAGPQLPGPVPIPGAPGPMPAPPLGAVPSPAPAENPVPLQVGAAPPAGLPGPAPVAATPGLSGGSQPMVAPPAPVPANGEQFGPVTAPVPTAPGAPR

SEQ ID NO: 512 - protein, 134 aa, Mycobacterium tuberculosis
MPLSDHEQRMLDQIESALYAEDPKFASSVRGGGFRAPTARRRLQGAALFIIGLGMLVSGVAFKETMIGSFPILSVFGFVVMFGGVVYAITGPRLSGRMDRGGSAAGASRQRRTKGAGGSFTSRMEDRFRRRFDE

SEQ ID NO: 513 - protein, 206 aa, Mycobacterium tuberculosis
LAIFLIDLPPSDMERRLGDALTVYVDAMRYPRGTETLRAPMWLEHIRRRGWQAVAAVEVTAAEQAEAADTTALPSAAELSNAPMLGVAYGYPGAPGQWWQQQVVLGLQRSGFPRLAIARLMTSYFELTELHILPRAQGRGLGEALARRLLAGRDEDNVLLSTPETNGEDNRAWRLYRRLGFTDIIRGYHFAGDPRAFAILGRTLPL

SEQ ID NO: 514 - protein, 301 aa, Mycobacterium tuberculosis
VTLNTIALELVPPNLEGGKERAIEDARKVVQYSAASGLDGRIRHVMMPGMIAEDDDRPIPMQPKLDVLDFWSIIKPELAGVHGLCTQVTAFMDEPSLHRRLVDLSDAGMEGIVFVGVPRTMQDGEGSGVAPTDALSLYRQLVANRGVIVIPTRDGEQGRLNFKCSRGATYGMTQLLYSDAIVGFLREFARTTEHRPEILLSFGFVPKVETRIGLINWLIQDPGNAAVADEQAFVQKLAGSEPARRRRLMVDLYKRVLDGVADLGFPLSIHLEATYGVSAAAFETFAEMLAYWSPAEPGKPD

SEQ ID NO: 515 - protein, 146 aa, Mycobacterium tuberculosis
MPGRAPGSTLARVGSIPAGDDVLDPDEPTYDLPRVAELLGVPVSKVAQQLREGHLVAVRRAGGVVIPQVFFTNSGQVVKSLPGLLTILHDGGYRDTEIMRWLFTPDPSLTITRDGSRDAVSNARPVDALHAHQAREVVRRAQAMAY

SEQ ID NO: 516 - protein, 168 aa, Mycobacterium tuberculosis
VRYFYDTEFIEDGHTIELISIGVVAEDGREYYAVSTEFDPERAGSWVRTHVLPKLPPPASQLWRSRQQIRLDLEEFLRIDGTDSIELWAWVGAYDHVALCQLWGPMTALPPTVPRFTRELRQLWEDRGCPRMPPRPRDVHDALVDARDQLRRFRLITSTDDAGRGAAR

SEQ ID NO: 517 - protein, 131 aa, Mycobacterium tuberculosis
VSGAHTDVRPELRKLAQAILDGIDPAVRVAAAMASGGGPGTGKCQQVWCPLCALAALVTGEQHPLLTVIADHSLALLEVIRAIVDDIDRSAKPPPEGPPGGGQTGASGGENTNGEGSMKSHYQAIPVTIEE

SEQ ID NO: 518 - protein, 144 aa, Mycobacterium tuberculosis
VADKTTQTIYIDADPGEVMKAIADIEAYPQWISEYKEVEILEADDEGYPKRARMLMDAAIFKDTLIMSYEWPEDRQSLSWTLESSSLLKSLEGTYRLAPKGSGTEVTYELAVDLAVPMIGMLKRKAERRLIDGALKDLKKRVEG

SEQ ID NO: 519 - protein, 129 aa, Mycobacterium tuberculosis
MNSIQIADETYVAADAARVSAAVADRCSWRRWWPDLRLQVTEDRADKGIRWTVTGALTGTMEIWLEPSMDGVLLHYFLHAEPTGVAAWQLARMNLARMTHHRRVAGKKMAFEVKTVLERSRPIGVSPVT

SEQ ID NO: 520 - protein, 214 aa, Mycobacterium tuberculosis
MVSRYSAYRRGPDVISPDVIDRILVGACAAVWLVFTGVSVAAAVALMDLGRGFHEMAGNPHTTWVLYAVIVVSALVIVGAIPVLLRARRMAEAEPATRPTGASVRGGRSIGSGHPAKRAVAESAPVQHADAFEVAAEWSSEAVDRIWLRGTVVLTSAIGIALIAVAAATYLMAVGHDGPSWISYGLAGVVTAGMPVIEWLYARQLRRVVAPQSS

SEQ ID NO: 521 - protein, 139 aa, Mycobacterium tuberculosis
MHIEARLFEFVAAFFVVTAVLYGVLTSMFATGGVEWAGTTALALTGGMALIVATFFRFVARRLDSRPEDYEGAEISDGAGELGFFSPHSWWPIMVALSGSVAAVGIALWLPWLIAAGVAFILASAAGLVFEYYVGPEKH

SEQ ID NO: 522 - protein, 230 aa, Mycobacterium tuberculosis
MPGPHSPNPGVGTNGPAPYPEPSSHEPQALDYPHDLGAAEPAFAPGPADDAALPPAAYPGVPPQVSYPKRRHKRLLIGIVVALALVSAMTAAIIYGVRTNGANTAGTFSEGPAKTAIQGYLNALENRDVDTIVRNALCGIHDGVRDKRSDQALAKLSSDAFRKQFSQVEVTSIDKIVYWSQYQAQVLFTMQVTPAAGGPPRGQVQGIAQLLFQRGQVLVCSYVLRTAGSY

SEQ ID NO: 523 - protein, 124 aa, Mycobacterium tuberculosis
MMAGEEAYLLPRDRGPVRRYVRDVVDSRRNLLGLFMPSALTLLFVMFAVPQVQFYLSPAMLILLALMTIDAIILGRKVGRLVDTKFPSNTESRWRLGLYAAGRASQIRRLRAPRPQVERGGDVG

SEQ ID NO: 524 - protein, 250 aa, Mycobacterium tuberculosis
MAKPRNAAESKAAKAQANAARKAAARQRRAQLWQAFTLQRKEDKRLLPYMIGAFLLIVGASVGVGVWAGGFTMFTMIPLGVLLGALVAFVIFGRRAQRTVYRKAEGQTGAAAWALDNLRGKWRVTPGVAATGNLDAVHRVIGRPGVIFVGEGSAARVKPLLAQEKKRTARLVGDVPIYDIIVGNGDGEVPLAKLERHLTRLPANITVKQMDTVESRLAALGSRAGAGVMPKGPLPTTAKMRSVQRTVRRK

SEQ ID NO: 525 - protein, 245 aa, Mycobacterium tuberculosis
MKAGVAQQRSLLELAKLDAELTRIAHRATHLPQRAAYQQVQAEHNAANDRMAALRIAAEDLDGQVSRFESEIDAVRKRGDRDRSLLTSGATDAKQLADLQHELDSLQRRQASLEDALLEVLERREELQAQQTAESRALQALRADLAAAQQALDEALAEIDQARHQHSSQRDMLTATLDPELAGLYERQRAGGGPGAGRLQGHRCGACRIEIGRGELAQISAAAEDEVVRCPECGAILLRLEGFEE

SEQ ID NO: 526 - protein, 271 aa, Mycobacterium tuberculosis
MPRLAFLLRPGWLALALVVVAFTYLCFTVLAPWQLGKNAKTSRENQQIRYSLDTPPVPLKTLLPQQDSSAPDAQWRRVTATGQYLPDVQVLARLRVVEGDQAFEVLAPFVVDGGPTVLVDRGYVRPQVGSHVPPIPRLPVQTVTITARLRDSEPSVAGKDPFVRDGFQQVYSINTGQVAALTGVQLAGSYLQLIEDQPGGLGVLGVPHLDPGPFLSYGIQWISFGILAPIGLGYFAYAEIRARRREKAGSPPPDKPMTVEQKLADRYGRRR

SEQ ID NO: 527 - protein, 158 aa, Mycobacterium tuberculosis
MPIATVCTWPAETEGGSTVVAADHASNYARKLGIQRDQLIQEWGWDEDTDDDIRAAIEEACGGELLDEDTDEVIDVVLLWWRDGDGDLVDTLMDAIGPLAEDGVIWVVTPKTGQPGHVLPAEIAEAAPTAGLMPTSSVNLGNWSASRLVQPKSRAGKR

SEQ ID NO: 528 - protein, 414 aa, Mycobacterium tuberculosis
VNDNQLAPVARPRSPLELLDTVPDSLLRRLKQYSGRLATEAVSAMQERLPFFADLEASQRASVALVVQTAVVNFVEWMHDPHSDVGYTAQAFELVPQDLTRRIALRQTVDMVRVTMEFFEEVVPLLARSEEQLTALTVGILKYSRDLAFTAATAYADAAEARGTWDSRMEASVVDAVVRGDTGPELLSRAAALNWDTTAPATVLVGTPAPGPNGSNSDGDSERASQDVRDTAARHGRAALTDVHGTWLVAIVSGQLSPTEKFLKDLLAAFADAPVVIGPTAPMLTAAHRSASEAISGMNAVAGWRGAPRPVLARELLPERALMGDASAIVALHTDVMRPLADAGPTLIETLDAYLDCGGAIEACARKLFVHPNTVRYRLKRITDFTGRDPTQPRDAYVLRVAATVGQLNYPTPH

SEQ ID NO: 529 - protein, 177 aa, Mycobacterium tuberculosis
VEPKEQQMRASNQFADVTSGVVYIHASPAAVCPHVEWALSSTLQAKANLVWTPQPALPPQLRAVTNWVGPVGTGARLANALRSWSVLRFEVTEDPSPGVDGQRFSHTPQLGLWSGAMSANGDIMVGEMRLRAMMAQGADTLAAELDSVLGTAWDQALEVYRDGGDAGEVTWLSRGVG

SEQ ID NO: 530 - protein, 272 aa, Mycobacterium tuberculosis
MTALEVLGGWPVPAAAAAVIGPAGVLATHGDTARVFALASVTKPLVARAAQVAVEEGVVNLDTPAGPPGSTVRHLLAHTSGLAMHSDQALARPGTRRMYSNYGFTVLAESVQRESGIEFGRYLTEAVCEPLGMVTTRLDGGPAAAGFGATSTVADLAVFAGDLLRPSTVSAQMHADATTVQFPGLDGVLPGYGVQRPNDWGLGFEIRNSKSPHWTGECNSTRTFGHFGQSGGFIWVDPKADLALVVLTARDFGDWALDLWPAISDAVLAEYT

SEQ ID NO: 531 - protein, 85 aa, Mycobacterium tuberculosis
LIGYVAVLGLGYVLGAKAGRRRYEQIASTYRALTGSPVARSMIEGGRRKIANRISPDAGFVTLAEIDNQTAVVQRGVERQPKTAR

SEQ ID NO: 532 - protein, 98 aa, Mycobacterium tuberculosis
MATRFMTDPHAMRDMAGRFEVHAQTVEDEARRMWASAQNISGAGWSGMAEATSLDTMAQMNQAFRNIVNMLHGVRDGLVRDANNYEQQEQASQQILSS

SEQ ID NO: 533 - protein, 113 aa, Mycobacterium tuberculosis
MMRRPITLAEQLDAEDAKLVVLARAAMARAEAGAGAAVRDVDGRTYAAAPVALSALELTGLQAAVAAAVSSGATGLQAAVLVAGSVDDPGIAAVRELAPTAAIIVTDRAGNPL

SEQ ID NO: 534 - protein, 168 aa, Mycobacterium tuberculosis
MKMVKSIAAGLTAAAAIGAAAAGVTSIMAGGPVVYQMQPVVFGAPLPLDPASAPDVPTAAQLTSLLNSLADPNVSFANKGSLVEGGIGGTEARIADHKLKKAAEHGDLPLSFSVTNIQPAAAGSATADVSVSGPKLSSPVTQNVTFVNQGGWMLSRASAMELLQAAGN

SEQ ID NO: 535 - protein, 316 aa, Mycobacterium tuberculosis
LHLVLGDEELLVERAVADVLRSARQRAGTADVPVSRMRAGDVGAYELAELLSPSLFAEERIVVLGAAAEAGKDAAAVIESAAADLPAGTVLVVVHSGGGRAKSLANQLRSMGAQVHPCARITKVSERADFIRSEFASLRVKVDDETVTALLDAVGSDVRELASACSQLVADTGGAVDAAAVRRYHSGKAEVRGFDIADKAVAGDVAGAAEALRWAMMRGEPLVVLADALAEAVHTIGRVGPQSGDPYRLAAQLGMPPWRVQKAQKQARRWSRDTVATAMRLVAELNANVKGAVADADYALESAVRQVAELVADRGR

SEQ ID NO: 536 - protein, 123 aa, Mycobacterium tuberculosis
MTDRSREPADPWKGFSAVMAATLILEAIVVLLAIPVVDAVGGGLRPASLGYLVGLAVLLILLTGLQRRPWAIWVNLGAQPVLVAGFAVYPGVGFIGVLFAALWVLIAYLRAEVRRRRDYRVSQ

SEQ ID NO: 537 - protein, 207 aa, Mycobacterium tuberculosis
MLEKAPQKSVADFWFDPLCPWCWITSRWILEVAKVRDIEVNFHVMSLAILNENRDDLPEQYREGMARAWGPVRVAIAAEQAHGAKVLDPLYTAMGNRIHNQGNHELDEVITQSLADAGLPAELAKAATSDAYDNALRKSHHAGMDAVGEDVGTPTIHVNGVAFFGPVLSKIPRGEEAGKLWDASVTFASYPHFFELKRTRTEPPQFD

SEQ ID NO: 538 - protein, 167 aa, Mycobacterium tuberculosis
MTHRSSRLEVGPVARGDVATIEHAELPPGWVLTTSGRISGVTEPGELSVHYPFPIADLVALDDALTYSSRACQVRFAIYLGDLGRDTAARAREILGKVPTPDNAVLLAVSPNQCAIEVVYGSQVRGRGAESAAPLGVAAASSAFEQGELVDGLISAIRVLSAGIAPG

SEQ ID NO: 539 - protein, 1624 aa, Mycobacterium tuberculosis
MTIDPGAKQDVEAWTTFTASADIPDWISKAYIDSYRGPRDDSSEATKAAEASWLPASLLTPAMLGAHYRLGRHRAAGESCVAVYRADDPAGFGPALQVVAEHGGMLMDSVTVLLHRLGIAYAAILTPVFDVHRSPTGELLRIEPKAEGTSPHLGEAWMHVALSPAVDHKGLAEVERLLPKVLADVQRVATDATALIATLSELAGEVESNAGGRFSAPDRQDVGELLRWLGDGNFLLLGYQRCRVADGMVYGEGSSGMGVLRGRTGSRPRLTDDDKLLVLAQARVGSYLRYGAYPYAIAVREYVDGSVVEHRFVGLFSVAAMNADVLEIPTISRRVREALAMAESDPSHPGQLLLDVIQTVPRPELFTLSAQRLLTMARAVVDLGSQRQALLFLRADRLQYFVSCLVYMPRDRYTTAVRMQFEDILVREFGGTRLEFTARVSESPWALMHFMVRLPEVGVAGEGAAAPPVDVSEANRIRIQGLLTEAARTWADRLIGAAAAAGSVGQADAMHYAAAFSEAYKQAVTPADAIGDIAVITELTDDSVKLVFSERDEQGVAQLTWFLGGRTASLSQLLPMLQSMGVVVLEERPFSVTRPDGLPVWIYQFKISPHPTIPLAPTVAERAATAHRFAEAVTAIWHGRVEIDRFNELVMRAGLTWQQVVLLRAYAKYLRQAGFPYSQSYIESVLNEHPATVRSLVDLFEALFVPVPSGSASNRDAQAAAAAVAADIDALVSLDTDRILRAFASLVQATLRTNYFVTRQGSARCRDVLALKLNAQLIDELPLPRPRYEIFVYSPRVEGVHLRFGPVARGGLRWSDRRDDFRTEILGLVKAQAVKNAVIVPVGAKGGFVVKRPPLPTGDPAADRDATRAEGVACYQLFISGLLDVTDNVDHATASVNPPPEVVRRDGDDAYLVVAADKGTATFSDIANDVAKSYGFWLGDAFASGGSVGYDHKAMGITARGAWEAVKRHFREIGIDTQTQDFTVVGIGDMSGDVFGNGMLLSKHIRLIAAFDHRHIFLDPNPDAAVSWAERRRMFELPRSSWSDYDRSLISEGGGVYSREQKAIPLSAQVRAVLGIDGSVDGGAAEMAPPNLIRAILRAPVDLLFNGGIGTYIKAESESDADVGDRANDPVRVNANQVRAKVIGEGGNLGVTALGRVEFDLSGGRINTDALDNSAGVDCSDHEVNIKILIDSLVSAGTVKADERTQLLESMTDEVAQLVLADNEDQNDLMGTSRANAASLLPVHAMQIKYLVAERGVNRELEALPSEKEIARRSEAGIGLTSPELATLMAHVKLGLKEEVLATELPDQDVFASRLPRYFPTALRERFTPEIRSHQLRREIVTTMLINDLVDTAGITYAFRIAEDVGVTPIDAVRTYVATDAIFGVGHIWRRIRAANLPIALSDRLTLDTRRLIDRAGRWLLNYRPQPLAVGAEINRFAAMVKALTPRMSEWLRGDDKAIVEKTAAEFASQGVPEDLAYRVSTGLYRYSLLDIIDIADIADIDAAEVADTYFALMDRLGTDGLLTAVSQLPRHDRWHSLARLAIRDDIYGALRSLCFDVLAVGEPGESSEQKIAEWEHLSASRVARARRTLDDIRASGQKDLATLSVAARQIRRMTRTSGRGISG

SEQ ID NO: 540 - protein, 491 aa, Mycobacterium tuberculosis
MAESGESPRLSDELGPVDYLMHRGEANPRTRSGIMALELLDGTPDWDRFRTRFENASRRVLRLRQKVVVPTLPTAAPRWVVDPDFNLDFHVRRVRVSGPATLREVLDLAEVILQSPLDISRPLWTATLVEGMADGRAAMLLHVSHAVTDGVGGVEMFAQIYDLERDPPPRSTPPQPIPEDLSPNDLMRRGINHLPIAVVGGVLDALSGAVSMAGRAVLEPVSTVSGILGYARSGIRVLNRAAEPSPLLRRRSLTTRTEAIDIRLADLHKAAKAGGGSINDAYLAGLCGALRRYHEALGVPISTLPMAVPVNLRAEGDAAGGNQFTGVNLAAPVGTIDPVARMKKIRAQMTQRRDEPAMNIIGSIAPVLSVLPTAVLEGITGSVIGSDVQASNVPVYPGDTYLAGAKILRQYGIGPLPGVAMMVVLISRGGWCTVTVRYDRASVRNDELFAQCLQAGFDEILALAGGPAPRVLPASFDTQGAGSVPRSVSGS

SEQ ID NO: 541 - protein, 273 aa, Mycobacterium tuberculosis
MNDPRRPQRFGPPLSGYGPTGPQVPPNPPTADPAYADQSPYASTYGGYVSPPWSPGGPPPRPPQWPPGPHEASPTQQLPQYWQYDQPPPGGFPPDGLTPPPPQGPRTPRWLWFAAGSAVLLVVALVIALVIANGSVKKQTAIEPLPPMPGPSPTRPTTTTPTPPSPSAAPAPTTTTGTPSETVAGAMQTVVYDVTGEGRAISITYMDSGNVIQTEFNVALPWRKEVSLSKSSLHPASVTIVNIGHNVTCSVTVAGVQVRQRTGAGLTICDAPS

SEQ ID NO: 542 - protein, 75 aa, Mycobacterium tuberculosis
VVDRDPNTIKQEIDQTRDQLAATIDSLAERANPRRLADDAKTRVIAFLRKPIVTVSLVGIGSVVVVVVIHKIRNR

SEQ ID NO: 543 - protein, 240 aa, Mycobacterium tuberculosis
MSVSRRDVLKFAAATPGVLGLGVVASSLRAAPASAGSLGTLLDYAAGVIPASQIRAAGAVGAIRYVSDRRPGGAWMLGKPIQLSEARDLSGNGLKIVSCYQYGKGSTADWLGGASAGVQHARRGSELHAAAGGPTSAPIYASIDDNPSYEQYKNQIVPYLRSWESVIGHQRTGVYANSKTIDWAVNDGLGSYFWQHNWGSPKGYTHPAAHLHQVEIDKRKVGGVGVDVNQILKPQFGQWA

SEQ ID NO: 544 - protein, 230 aa, Mycobacterium tuberculosis
MTNWMLRGLAFAAAMVVLRLFQGALINAWQMLSGLISLVLLLLFAIGGVVWGVMDGRADAKASPDPDRRQDLAMTWLLAGLVAGALSGAVAWLISLFYKAIYTGGPINELTTFAAFTALIVFLVGIVGVAVGRWLVDRQLAKAPVRHHGLAAEHERAADTDVFSAVRADDSPTGEMQVAQPEAQTAAVATVEREAPTEVIRTTESDTPTEVIRTDTEADQTKPGDEPKKD

SEQ ID NO: 545 - protein, 115 aa, Mycobacterium tuberculosis
MESFVLFLPFLLIMGGFMYFASRRQRRAMQATIDLHDSLQPGERVHTTSGLEATIVAIADDTIDLEIAPGVVTTWMKLAIRDRILPDDDIDEELNEDLDKDVDDVAGERRVTNDS

SEQ ID NO: 546 - protein, 351 aa, Mycobacterium tuberculosis
MTWLVLAGAVLLVVLVAFGAWGYQTANRLNRLNVRYDLSWQSLDSALARRAVVARAVAIDAYGGAPQGSRLAALADAAEGAPRHARENAENELSAALAMVNPASLPAALIAELADAEARVLLARRFHNDAVRDTLALGERRLVRLLRLGGTAVLPTYFEIVERPHALVHGDQGASGRRTSARVVLLDDSGAVLLLCGSDPANPAFRDGAAPKWWFTVGGQVRPGERLAQAAARELAEETGLRVAPADMIGPIWRRDEVFEFNGSLIDSEEFYLVHRTRRFEPAVQGRTELERRYIRDARWCDANDIAQLVAAGERVYPLQLGELLPAANRLVDVALDNGAARDAGVPQPIR

SEQ ID NO: 547 - protein, 433 aa, Mycobacterium tuberculosis
VYGALVTAADSIRTGLGASLLAGFRPRTGAPSTATILRSALWPAAVLSVLHRSIVLTTNGNITDDFKPVYRAVLNFRRGWDIYNEHFDYVDPHYLYPPGGTLLMAPFGYLPFAPSRYLFISINTAAILVAAYLLLRMFNFTLTSVAAPALILAMFATETVTNTLVFTNINGCILLLEVLFLRWLLDGRASRQWCGGLAIGLTLVLKPLLGPLLLLPLLNRQWRALVAAVVVPVVVNVAALPLVSDPMSFFTRTLPYILGTRDYFNSSILGNGVYFGLPTWLILFLRILFTAITFGALWLLYRYYRTGDPLFWFTTSSGVLLLWSWLVMSLAQGYYSMMLFPFLMTVVLPNSVIRNWPAWLGVYGFMTLDRWLLFNWMRWGRALEYLKITYGWSLLLIVTFTVLYFRYLDAKADNRLDGGIDPAWLTPEREGQR

SEQ ID NO: 548 - protein, 210 aa, Mycobacterium tuberculosis
LTSAGDDAERSDEEERRLTSAEPALFREAVAAMNAVTVRPEIELGPIRPPQRLAPYSYALGAEIKHPELDVIPERSEGDAFGRLIMLYDPDGSDAWDGTIRLVAYVQADLDSSEAVDPLLPEVAWSWLVDALTARTDQVRALGGTVTATTSVRYGDISGPPRAHQLELRASWTATTPDLGAHVQAFCDVLEHAAGLPPAGVTDLGSRSRA

SEQ ID NO: 549 - protein, 165 aa, Mycobacterium tuberculosis
MKVNIDPTAPTFATYRRDMRAEQMAEDYPVVSIDSDALDAARMLAEHRLPGLLVTAGAGKQYAVLPASQVVRFIVPRYVQDDPLLAGVLNESTADRCAERLSGKKVRDVLPDHLVEVPPANADDTIIEVAAVMARLRSPLLAVVKDGSLLGVVTASRLLAAALKT

SEQ ID NO: 550 - protein, 235 aa, Mycobacterium tuberculosis
MAVDLDGVTTVLLPGTGSDNDYVRRAFSAPLRRAGAVLVTPVPHPGRLIDGYRAALDDAARDGPVVVGGVSLGAAVAAAWALEHPDRAVAVLAALPAWTGEPELAPAAQAARYTAARLRCDGLAATTTRMRASSPVWLAEELTRSWRVQWPELPDAMEEAAAYVAPSRAELARLVAPLAVAAAVDDPIHPLQVAADWVSVAPHAALRTVTLDEIGADAAALGSACLAALAEVSGA

SEQ ID NO: 551 - protein, 259 aa, Mycobacterium tuberculosis
MAFGRRTGKDGGKRKAGHAPVQPADEHVRPEDTVVASAAAASGVEDQEELQGPFDIDDFDDPSVAVLARLDLGSVLIPMPAAGQVQVELTESGVPSAVWVITPNGRYSIAAYAAPKTGGLWREVAGELADSLRKDSAKVSIKDGPWGREVIGIAAGVVRFIGVDGYRWMIRCVVNGPQETVDALTEEAREALADTVVRRGDTPLPVRTPLPVHLPEPMAAQLREAAAAQADTQRQAAAGVARRGAQGSAMQQLRSTTGG

SEQ ID NO: 552 - protein, 161 aa, Mycobacterium tuberculosis
VSGTRLAPHSVRYRERLWVPWWWWPLAFALAALIAFEVNLGVAALPDWVPFATLFTVAAGTLLWLGRVEIRVTAGSADGAGVKLWAGPAHLPVAVIARSAEIPATAKSAALGRQLDPAAYVLHRAWVGPMVLVVLDDPNDPTPYWLVSCRHPERVLSALRS

SEQ ID NO: 553 - protein, 100 aa, Mycobacterium tuberculosis
MPTDYDAPRRTETDDVSEDSLEELKARRNEAASAVVDVDESESAESFELPGADLSGEELSVRVVPKQADEFTCSSCFLVQHRSRLASEKNGVMICTDCAA

SEQ ID NO: 554 - protein, 216 aa, Mycobacterium tuberculosis
VVAQITEGTAFDKHGRPFRRRNPRPAIVVVAFLVVVTCVMWTLALTRPPDVREAAVCNPPPQPAGSAPTNLGEQVSRTDMTDVAPAKLSDTKVHVLNASGRGGQAADIAGALQDLGFAQPTAANDPIYAGTRLDCQGQIRFGTAGQATAAALWLVAPCTELYHDSRADDSVDLALGTDFTTLAHNDDIDAVLANLRPGATEPSDPALLAKIHANSC

SEQ ID NO: 555 - protein, 82 aa, Mycobacterium tuberculosis
MSGMQTQTIERTDADERVDDGTGSDTPKYFHYVKKDKIAESAVMGSHVVALCGEVFPVTRAPKPGSPVCPDCKRIYDTLKKG

SEQ ID NO: 556 - protein, 148 aa, Mycobacterium tuberculosis
MWDSRVMKHGLRLGFNGQFDDFDDFDDKGRPVLITAAAPSYEVEHRTRVRKYLTLMAFRVPALILAAIAYGAWHNGLISLLIVAASVPLPWMAVLIANDRPPRRADEPRRFDVARRRIPLFPTAERPALEPRRQPAERSAPRGFADHG

SEQ ID NO: 557 - protein, 324 aa, Mycobacterium tuberculosis
MARDQGADEAREYEPGQPGMYELEFPAPQLSSSDGRGPVLVHALEGFSDAGHAIRLAAAHLKAALDTELVASFAIDELLDYRSRRPLMTFKTDHFTHSDDPELSLYALRDSIGTPFLLLAGLEPDLKWERFITAVRLLAERLGVRQTIGLGTVPMAVPHTRPITMTAHSNNRELISDFQPSISEIQVPGSASNLLEYRMAQHGHEVVGFTVHVPHYLTQTDYPAAAQALLEQVAKTGSLQLPLAVLAEAAAEVQAKIDEQVQASAEVAQVVAALERQYDAFIDAQENRSLLTRDEDLPSGDELGAEFERFLAQQAEKKSDDDPT

SEQ ID NO: 558 - protein, 165 aa, Mycobacterium tuberculosis
MTPVRPPHTPDPLNLRGPLDGPRWRRAEPAQSRRPGRSRPGGAPLRYHRTGVGMSRTGHGSRPVPPATTVGLALLAAAITLWLGLVAQFGQMITGGSADGSADSTGRVPDRLAVVRVETGESLYDVAVRVAPNAPTRQVADRIRELNGLQTPALAVGQTLIAPVG

SEQ ID NO: 559 - protein, 82 aa, Mycobacterium tuberculosis
MPCLARQPVDLPPWAGPRCGPYCPRARITLLQRTTIAKSNRKYYENGYPADVKLMPGHAAVVSNRAAARAGFALPCRKRQPD

SEQ ID NO: 560 - protein, 231 aa, Mycobacterium tuberculosis
VLSAIGIVPSAPVLVPELAGAAAAELADLGAAVIAAASLLPKSWIAVGTGRADDVVRPTDVGTFAGFGADVRVGLAPQDGDGVAVPVELPLCALLTAWVRGQARPEARAQVHVYASDHGSDAAVARGRQLRADIDREPDPIGVLVVADGLNTLTPRAPGGYDPDGAGMQRALDDALASGDLAVLTRLPAQVLGRVAFQVLAGLAEPGPRSAKEFYRGAPHGVGYFAGVWQP

SEQ ID NO: 561 - protein, 204 aa, Mycobacterium tuberculosis
MMSHEHDAGDLDALRAEIEAAERRVAREIEPGARALVVAILVFVLLGSFILPHTGSVRGWDVLFSSHGAGRAAVALPSRVFAWLALVFGVGFSMLALLTRRWALAWVALAGSAMASGTGLLAVWSRQTVAAGHPGPGIGLIVAWITAIVLTFHWAQVVWSRTIVQLAAEERRRRVVAQQQCKTLLDHVQTDSEAGTTPDRGTDR

SEQ ID NO: 562 - protein, 68 aa, Mycobacterium tuberculosis
MLAGVRLTEFHERVALHFGAAYGSSVLLDHVLTGFDGRSAAQAIEDGVEPRDVWRALCADFDVPHDRW

SEQ ID NO: 563 - protein, 149 aa, Mycobacterium tuberculosis
MAELTETSPETPETTEAIRAVEAFLNALQNEDFDTVDAALGDDLVYENVGFSRIRGGRRTATLLRRMQGRVGFEVKIHRIGADGAAVLTERTDALIIGPLRVQFWVCGVFEVDDGRITLWRDYFDVYDMFKGLLRGLVALVVPSLKATL

SEQ ID NO: 564 - protein, 150 aa, Mycobacterium tuberculosis
VRRLLIVHHTPSPHMQEMFEAVVSGATDPEIEGVEVVRRPALTVSPIEMLEADGYLLGTPANLGYISGALKHAFDVCYYLCLDTTRGRSFGAYIHGNEGTEGAERAVDAITTGLGWVQAAETVVVMGKPSKADIEACWNLGATVAAQLMG

SEQ ID NO: 565 - protein, 157 aa, Mycobacterium tuberculosis
MTRRTLYVQLIIAFMCVAMVAYLVMLGRVAVAMIGSGRAAAAGLGLALLILPVIGLWAMIATLRAGFAYQRLARLIAEDGLDIDASALPRRASGRIQRDAADALFAAVRTELEDDADDWRRWYRLARAYDYAGDRRRAREAMKTALQLEGRARPGAR

SEQ ID NO: 566 - protein, 324 aa, Mycobacterium tuberculosis
VTWKGSGQETVGAEPTLWAISDLHTGHLGNKPVAESLYPSSPDDWLIVAGDVAERTDEIRWSLDLLRRRFAKVIWVPGNHELWTTNRDPMQIFGRARYDYLVNMCDEMGVVTPEHPFPVWTERGGPATIVPMFLLYDYSFLPEGANSKAEGVAIAKERNVVATDEFLLSPEPYPTRDAWCHERVAATRARLEQLDWMQPTVLVNHFPLLRQPCDALFYPEFSLWCGTTKTADWHTRYNAVCSVYGHLHIPRTTWYDGVRFEEVSVGYPREWRRRKPYSWLRQVLPDPQYAPGYLNDFGGHFVITPEMRTQAAQFRERLRQRQSR

SEQ ID NO: 567 - protein, 99 aa, Mycobacterium tuberculosis
VRTCVGCRKRGLAVELLRVVAVSTGNGNYAVIVDTATSLPGRGAWLHPLRQCAQQAIRRRAFARALRIAGSPDTSAVVEYLESLGELEPPGNRTGSNRT

SEQ ID NO: 568 - protein, 181 aa, Mycobacterium tuberculosis
VLRAAPVINRLTNRPISRRGVLAGGAALAALGVVSACGESAPKAPAVEELRSPLDQARHDGALAAAAATAIGIPPQVAAALTVVATQRTSHARALATEIARAAGKLVSATSETSSSSPSPTDPAAPPPAVSDVIDSLRTSAGEASRLVATTSGYRAGLLASIAASCTASYTVALVPSGPSI

SEQ ID NO: 569 - protein, 162 aa, Mycobacterium tuberculosis
MTSSEPAHGATPKRSPSEGSADNAALCDALAVEHATIYGYGIVSALSPPGVNFLVADALKQHRHRRDDVIVMLSARGVTAPIAAAGYQLPMQVSSAADAARLAVRMENDGATAWRAVVEHAETADDRVFASTALTESAVMATRWNRVLGAWPITAAFPGGDE

SEQ ID NO: 570 - protein, 104 aa, Mycobacterium tuberculosis
MFGQWEFDVSPTGGIAVASTEVEHFAGSQHEVDTAEVPSAAWGWSRIDHRTWHIVGLCIFGFLLAMLRGNHVGHVEDWFLITFAAVVLFVLARDLWGRRRGWIR

SEQ ID NO: 571 - protein, 128 aa, Mycobacterium tuberculosis
MTTLKTMTRVQLGAMGEALAVDYLTSMGLRILNRNWRCRYGELDVIACDAATRTVVFVEVKTRTGDGYGGLAHAVTERKVRRLRRLAGLWLADQEERWAAVRIDVIGVRVGPKNSGRTPELTHLQGIG

SEQ ID NO: 572 - protein, 101 aa, Mycobacterium tuberculosis
MSAEDLEKYETEMELSLYREYKDIVGQFSYVVETERRFYLANSVEMVPRNTDGEVYFELRLADAWVWDMYRPARFVKQVRVVTFKDVNIEEVEKPELRLPE

SEQ ID NO: 573 - protein, 626 aa, Mycobacterium tuberculosis
VRVTRLVDAESTRCDVGPAPKSVAMLHFTAATSRFRLGRERANSVRSDGGWGVLQPVSATFNPPLRGWQRRALVQYLGTQPRDFLAVATPGSGKTSFALRIAAELLRYHTVEQVTVVVPTEHLKVQWAHAAAAHGLSLDPKFANSNPQTSPEYHGVMVTYAQVASHPTLHRVRTEARKTLVVFDEIHHGGDAKTWGDAIREAFGDATRRLALTGTPFRSDDSPIPFVSYQPDADGVLRSQADHTYGYAEALADGVVRPVVFLAYSGQARWRDSAGEEYEARLGEPLSAEQTARAWRTALDPEGEWMPAVITAADRRLRQLRAHVPDAGGMIIASDRTTARAYARLLTTMTAEEPTVVLSDDPGSSARITEFAQGTSRWLVAVRMVSEGVDVPRLSVGVYATNASTPLFFAQAIGRFVRSRRPGETASIFVPSVPNLLQLASALEVQRNHVLGRPHRESAHDPLDGDPATRTQTERGGAERGFTALGADAELDQVIFDGSSFGTATPTGSDEEADYLGIPGLLDAEQMRALLHRRQDEQLRKRAQLQKGATQPATSGASASVHGQLRDLRRELHTLVSIAHHRTGKPHGWIHDERRRRCGGPPIAAATRAQIKARIDALRQLNSERS

SEQ ID NO: 574 - protein, 207 aa, Mycobacterium tuberculosis
VDLGGVRRRISLMARQHGPTAQRHVASPMTVDIARLGRRPGAMFELHDTVHSPARIGLELIAIDQGALLDLDLRVESVSEGVLVTGTVAAPTVGECARCLSPVRGRVQVALTELFAYPDSATDETTEEDEVGRVVDETIDLEQPIIDAVGLELPFSPVCRPDCPGLCPQCGVPLASEPGHRHEQIDPRWAKLVEMLGPESDTLRGER

SEQ ID NO: 575 - protein, 199 aa, Mycobacterium tuberculosis
MTECFLSDQEIRKLNRDLRILIAANGTLTRVLNIVADDEVIVQIVKQRIHDVSPKLSEFEQLGQVGVGRVLQRYIILKGRNSEHLFVAAESLIAIDRLPAAIITRLTQTNDPLGEVMAASHIETFKEEAKVWVGDLPGWLALHGYQNSRKRAVARRYRVISGGQPIMVVTEHFLRSVFRDAPHEEPDRWQFSNAITLAR

SEQ ID NO: 576 - protein, 210 aa, Mycobacterium tuberculosis
VVAARPAERSGDPAAVRVPVPSAWWVLIGGVIGLFASMTLTVEKVRILLDPIYVPSCNVNPIVSCGSVMTTPQASLLGFPNPLLGIAGFTVVVVTGVLAVAKVPLPRWYWIGLAVGILVGVAFVHWLIFQSLYRIGALCPYCMVVWAVIATLLVVVASIVFGPMRENRGSQERVGARLLYQWRWSLATLWFTTVFLLIMVRFWDYWSTLI

SEQ ID NO: 577 - protein, 181 aa, Mycobacterium tuberculosis
VTGESDGPPRAVLIAAAALAAAVIGVILVVAANRQPPERPVVIPAVPAPQATGPGCKALLAALPQRLGEYRRAPVAEPTTAGATAWRTGPNSTPVILRCGLDRPAEFVVGSAIQVVDRVQWFQVAAQNPDEPGRSTWYTVDRPVYVALTLPSGSGPTAIQELSDVIDHTIPAVPIDPAPAR

SEQ ID NO: 578 - protein, 279 aa, Mycobacterium tuberculosis
VTSSNDSHWQRPDDSPGPMPGRPVSASLVDPEDDLTPARYAGDFGSGTTTVIPPYDAASSGVGNSGYSLIEAAEPLPYVQPQPGRQVPAGSAGIDMDDDERVRAAGRRGTQNLGLLILRVGLGAVLIAHGLQKLFGWWDGQGLAGFQNSLSDIGYQHAEILAYVSAGGEIVAGVLLVLGLFTPLAAAGALAFLINGLLAGISAQHSRPVAYFLQDGHEYQITLVVMAVAVILSGPGRYGLDAARGWAHRPFIGSFVALLGGIAAGIAVWVLLNGANPLA

SEQ ID NO: 579 - protein, 218 aa, Mycobacterium tuberculosis
VRSYLLRIELADRPGSLGSLAVALGSVGADILSLDVVERGNGYAIDDLVVELPPGAMPDTLITAAEALNGVRVDSVRPHTGLLEAHRELELLDHVAAAEGATARLQVLVNEAPRVLRVSWCTVLRSSGGELHRLAGSPGAPETRANSAPWLPIERAAALDGGADWVPQAWRDMDTTMVAAPLGDTHTAVVLGRPGPEFRPSEVARLGYLAGIVATMLR

SEQ ID NO: 580 - protein, 337 aa, Mycobacterium tuberculosis
VSVFATATGIGSWPGTAAREAAQVVVGELAGALAYLTELPARGVGADMLGRAGGLLVDVAIDTVPRGYRIAARPGAVTRRAASLLDEDMDALEEAWETAGLRGCGRAVKVQAPGPVTLVAGLELANGHRAITDPGAVRDLAASLAEGVAAHRAALARRLDTPVVVQFDEPSLPAALGGRLTGVTALSPVAPLDETVAEALLDTCIAAVDADVALHSCSPDLPWDLLQRSRISAVSVDASTLQAADLDAVAAFVESGRTVVLGLVPVTAPERAPSMEEVAAAAVAVTDRLGVPRSALRDRLGVSPACGLANATGQWARTAVGLARDVAEAFARDPEAI

SEQ ID NO: 581 - protein, 360 aa, Mycobacterium tuberculosis
LAAGPALSARGYLALNGQTPAGCSLMEWQNDNNGRQRWCVRLVQGGGFAGPLFDGFDNLYVGQPGAIISFPPTQWTRWRQPVIGMPSTPRFLGHGRLLVSTHLGQLLVFDTRRGMVVGSPVDLVDGIDPTDATRGLADCAPARPGCPVAAAPAFSSVNGTVVVSVWQPGEPAAKLVGLKYHAEQLVREWTSDAVSAGVLASPVLSADGSTVYVNGRDHRLWALNAADGKAKWSAPLGFLAQTPPALTPHGLIVSGGGPDTALAAFRDAGDHAEGAWRRDDVTALSTASLAGTGVGYTVISGPNHDGTPGLSLLVFDPANGHTVNSYPLPGATGYPVGVSVGNDRRVVTATSDGQVYSFAP

SEQ ID NO: 582 - protein, 327 aa, Mycobacterium tuberculosis
MTRSSNIPADATPNPHATAEQVAAARHDSKLAQVLYHDWEAENYDEKWSISYDQRCVDYARGRFDAIVPDEVIAQLPYDRALELGCGTGFFLLNLIQAGVARRGSVTDLSPGMVKVATRNGQALGLDIDGRVADAEGIPYDDDAFDLVVGHAVLHHIPDVELSLREVVRVLKPGGRFVFAGEPTTVGDGYARTLSTLTWRVVTNATKLPGLRGWRRPQGELDESSRAAALEALVDLHTFTPQDLQRIAHNAGAVEVQTATEEFTAAMLGWPLRTFECTVPPGRLGWGWARFAFTSWKTLGWVDANVWRHVVPKGWFYNVMITGVKPS

SEQ ID NO: 583 - protein, 472 aa, Mycobacterium tuberculosis
VSTGEVMGDLPFGFSSGDDPPEDPSGRDKRGKDGADSGSGANPLGAFGIGGEFNMADLGQIFTRLGEMFGGVGTAMAAGKTSGPVNYDLARQVASSSIGFIAPIPAATNSAIADAVHLADTWLDGATSLPAGATKAVGWSPTDWVDNTLATWKRLCDPMAQQISTVWASSLPEEAKSMAGPLLSIMSQMGGIAFGSQLGQALGRLSREVLTSTDIGLPLGPKGVAAILPGAVESFAAGLEQPRSEILTFLATREAAHHRLFSHVPWLASQLLGAVEAYAMGMKIDMTGIEELARDINPTSLADPAAMEQLLSQGVFEPKATPAQTQALERLETLLALIEGWVQTVVTAALGERIPGEAALSETLRRRRASGGPAEQTFATLVGLELRPRKLREAGALWERLTRAVGMDARDAVWQHPDLLPATDDLDDPAAFIDRVIGGDTSGIDEAIAELERDQQARGADDSGHDGGPVDN

SEQ ID NO: 584 - protein, 292 aa, Mycobacterium tuberculosis
MGSTRLTGVNVEPPPEHVLVAFGLAGAQPILLGAGWEGGWRCGEVVLSMVADNARAAWSARVRETLFVDGVRLARPVRSTDGRYVVSGWRADTFVAGAPEPRHDEVVSAAVRLHEATGKLERPRFLTQGPAAPWAEIDVFVAADRAGWEERPLQSVPPGVPTAPPAADPQRSIDLINQLAGLRKPTKSPNQLVHGDLYGTVLFAGTAPPGITDITPYWRPASWAAGVAVVDALSWGAADDGLIERWNALPEWPQMLLRALMFRLAVYALHPRSTAEAFPGLAHTAALVRLVL

SEQ ID NO: 585 - protein, 285 aa, Mycobacterium tuberculosis
VSTYGWRAYALPVLMVLTTVVVYQTVTGTSTPRPAAAQTVRDSPAIGVVGTAILDAPPRGLAVFDANLPAGTLPDGGPFTEAGDKTWRVVPGTTPQVGQGTVKVFRYTVEIENGLDPTMYGGDNAFAQMVDQTLTNPKGWTHNPQFAFVRIDSGKPDFRISLVSPTTVRGGCGYEFRLETSCYNPSFGGMDRQSRVFINEARWVRGAVPFEGDVGSYRQYVINHEVGHAIGYLRHEPCDQQGGLAPVMMQQTFSTSNDDAAKFDPDFVKADGKTCRFNPWPYPIP

SEQ ID NO: 586 - protein, 90 aa, Mycobacterium tuberculosis
VEVKIGITDSPRELVFSSAQTPSEVEELVSNALRDDSGLLTLTDERGRRFLIHTARIAYVEIGVADARRVGFGVGVDAAAGSAGKVATSG

SEQ ID NO: 587 - protein, 186 aa, Mycobacterium tuberculosis
VALGAVATAVIINSGDSTSTKAIVGAPAPRTVISTSPRPTAPTSTSPHPSPSTLRPQLPPETVTTVAPPGTGPTTVPTRTPTAAPPQTAVPPPAPLNPRTVVYRVTGTKQLFDLVNVVYTDARGFPVTDFNVSLPWTKMVVLNPGVQTESVVATSLYSRLNCSIVNTGAQTVVASTNNAIIATCTR

SEQ ID NO: 588 - protein, 407 aa, Mycobacterium tuberculosis
MVKPERRTKTDIAAAATIAVVVAVAASLIWWTSDARATISRPAAVAVPTPAPAREVPTSLKQLWTAASPATRVPVVVGGTVATGDGRQVDGRDPATGESLWSYARDTDLCGVTWVYHYAVAVYRYDRGCGQVSTIDGSTGRRGAARSGYADPRVRLFSDGTTVLSAGDTRLELWRSDMVRMLAYGEIDARVKPSNRGLQSGCTLESAAASSAAVSVLEACTNQADLRLVLLRPGKEDDEPIQRIVPEPGVRPGSGARVLVVSQNNTAVYLPARSGAQPRVDVIDETGATVSSTLLAKPPSTSAVASRTGNLVTWWTGDALLVFDAGNLTQRYTIAAGETTAPVGPGVMMAGQLLVPVTGGIGVYDPVSGANNRYIPVTRPPSTSAVIPAVSGSRVIEQRGDTLVALG

SEQ ID NO: 589 - protein, 143 aa, Mycobacterium tuberculosis
VPVRAPAAVRGAGLIVAVQGGAALVVAAALLVRGLAGADQHIVNGLGTAGWFVLVGGAVLAAGCRLAVGKLWGRGLAVFAQLLLLPVAWYLIVGSHQPAIGIPVGIIALGVLVLLFSPPSIRWAAGRDQRGAASAANRGPDSR

SEQ ID NO: 590 - protein, 213 aa, Mycobacterium tuberculosis
VLDLVLPLECGGCGAPATRWCAACAAELSVAAGEPHVVSPRVDPQVPVFALGRYAGVRRQAILAMKEHGRRDLVAPLACALIVGVDHLLSWGMLENPLTMVPAPTRRWAARRRGGDPVSRMARIAGATLGRHHDVTVVPALRMRALARDSVGLGASARERNITGRVLLRGQRPRNEVVLVDDIITTGATARESVRVLQAAGVRVGAVLAVAAA

SEQ ID NO: 591 - protein, 346 aa, Mycobacterium tuberculosis
VNVARAIDLEDTEGLIAADRGALLRAASMAGAQVRAIAAAADEGELDLLRGSDRPRSVIWVTGRGTAETAGTILASTLGAGAAEPIVLASAAPPWVGPLDVLIVAGDDPGDPALVGAAAIGVRRGARVVVVAPYEGPLRDSTAGRVAVLEPRLRVPDEFGLSRYLAAGLAALQTVDPKLRIDLASLADELDAEALRNSAGREVFTNPAKALAARVSGCQLALAGDNAATLALARHGSSVMLRIANQVVAATRLSDAVVALRAGTPPDALFHDEEIDGPAPQRLRVLALALAGERTVVAARVAGLDDAYLVAAEDVPELLDAPVGSGGAVLAVRLEMAAVYLRLVRG

SEQ ID NO: 592 - protein, 163 aa, Mycobacterium tuberculosis
MRVSGASAALVHDSLSVVNVPRRCCRPGCPHYAVATLTFVYSDSTAVIGPLATAREPHSWDLCVGHAGRITAPRGWELVRHAGPLPSHPDEDDLVALADAVREGGPSAGRRHHPGGNGAPLHGFDDFPAAATGAPTGGGVLAPPEPGAGRRRGHLRVLPDPAD

SEQ ID NO: 593 - protein, 139 aa, Mycobacterium tuberculosis
MRGPLLPPTVPGWRSRAERFDMAVLEAYEPIERRWQERVSQLDIAVDEIPRIAAKDPESVQWPPEVIADGPIALARLIPAGVDVRGNATRARIVLFRKPIERRAKDTEELGELLHEILVAQVAIYLDVDPSVIDPTIDD

SEQ ID NO: 594 - protein, 93 aa, Mycobacterium tuberculosis
MAIQVFLAKATTTVITGLAGVTAYEILKKAAAKAPLRQTAVSAAALGLRGTRKAEEAAESARLKVADVMAEARERIGEESPTPAISDLHDHDH

SEQ ID NO: 595 - protein, 272 aa, Mycobacterium tuberculosis
MNEVTAGVRELATAIMVSRHLTGVLAGHGSQTVTYHFASILCSSVHSLVVSFADATIARLPGVVQPYAQRHHELIKFAIVGGTTFIIDTAIFYTLKLTVLEPKPVTAKVIAGIVAVIASYVLNREWSFRDRGGRERHHEALLFFAFSGVGVLLSMAPLWFSSYILQLRVPTVSLTMENIADFISAYIIGNLLQMAFRFWAFRRWVFPDEFARNPDKALESALTAGGIAEVFEDVLEGGFEDGNVTLLRAWRNRANRFAQLGDSSEPRVSKTS

SEQ ID NO: 596 - protein, 172 aa, Mycobacterium tuberculosis
MSYPENVLAAGEQVVLHRHPHWNRLIWPVVVLVLLTGLAAFGSGFVNSTPWQQIAKNVIHAVIWGIWLVIVGWLTLWPFLSWLTTHFVVTNRRVMFRHGVLTRSGIDIPLARINSVEFRDRIFERIFRTGTLIIESASQDPLEFYNIPRLREVHALLYHEVFDTLGSDESPS

SEQ ID NO: 597 - protein, 177 aa, Mycobacterium tuberculosis
MGTCPCESSERNEPVSRVSGTNEVSDGNETNNPAEVSDGNETNNPAEVSDGNETNNPAPVSRVSGTNEVSDGNETNNPAPVSRVSGTNEVSDGNETNNPAPVTEKPLHPHEPHIEILRGQPTDQELAALIAVLGSISGSTPPAQPEPTRWGLPVDQLRYPVFSWQRITLQEMTHMRR

SEQ ID NO: 598 - protein, 420 aa, Mycobacterium tuberculosis
MVADLVPIRLSLSAGDRYTLWAPRWRDAGDEWEAFLGKDDDLYGFESVSDLVAFVRTDTENDLVDHPAWQDLTGAHAHNLNPAEDNQFDLVVVEELLAEKPTAESVAALAASLAIVSAIGSVCELAAVSKFFNGNPILGTVSGGLEHFTGKAGNKRWNSIAEVIGRSWDDVLAAIDEIISTPEVDAELSEKVAEELAEEPEGAEEVAAEVEATQDTQEAAESDDEEADAPGDSVVLGGDRDFWLQVGIDPIQIMTGTATFYTLRCYLDDRPIFLGRNGRISVFGSERALARYLADEHDHDLSDLSTYDDIRTAATDGSLAVAVTDDNVYVLSGLVDDFADGPDAVDREQLDLAVELLRDIGDYSEDSAVDKALETTRPLGQLVAYVLDPHSVGKPTAPYAAAVREWEKLERFVESRLRRE

SEQ ID NO: 599 - protein, 129 aa, Mycobacterium tuberculosis
MNLRRHQTLTLRLLAASAGILSAAAFAAPAQANPVDDAFIAALNNAGVNYGDPVDAKALGQSVCPILAEPGGSFNTAVASVVARAQGMSQDMAQTFTSIAISMYCPSVMADVASGNLPALPDMPGLPGS

SEQ ID NO: 600 - protein, 214 aa, Mycobacterium tuberculosis
MTLNLSVDEVLTTTRSVRKRLDFDKPVPRDVLMECLELALQAPTGSNSQGWQWVFVEDAAKKKAIADVYLANARGYLSGPAPEYPDGDTRGERMGRVRDSATYLAEHMHRAPVLLIPCLKGREDESAVGGVSFWASLFPAVWSFCLALRSRGLGSCWTTLHLLDNGEHKVADVLGIPYDEYSQGGLLPIAYTQGIDFRPAKRLPAESVTHWNGW

SEQ ID NO: 601 - protein, 136 aa, Mycobacterium tuberculosis
VRDHLPPGLPPDPFADDPCDPSAALEAVEPGQPLDQQERMAVEADLADLAVYEALLAHKGIRGLVVCCDECQQDHYHDWDMLRSNLLQLLIDGTVRPHEPAYDPEPDSYVTWDYCRGYADASLNEAAPDADRFRRR

SEQ ID NO: 602 - protein, 275 aa, Mycobacterium tuberculosis
VNETPHAPVVEQVLVAAAFGNQPGSWPLPTAITPHHLWLRAVAAGGQGRYAHAYGDLSVLRRLVPAGPLASLAHSTQGSLLRQLGWHTLARGWDGRALALAGADREAGADALIGLAADALGVGRFAAAGALLDRADPLVVSPLVADRLAVRRRWVAAELAMATGDGATAVRHAEEAVELTQAMAVASARHRVKSDVVLAAALCSAGAVARARAVGEEALDATARFGLLPLRWALACLLIDIGTVTFSAQQLRELTKIRNICAGQVRRAGGCWRTA

SEQ ID NO: 603 - protein, 280 aa, Mycobacterium tuberculosis
VPRIRKLVAALHRRGPHRVLRGDLAFAGLPGVVYTPEAGLHLPGVAFGHDWLTGTSRYSGLLEHLASWGIVAAAPDSERGLAPSVLNLAFDLGVALDIVAGVRLGPGKISVHPAKLGLVGHGFGGSAAVFAAAGLTGTHVKSVAAIFPTVTNPAAEQPAATLDVPGLILTAPGDPKTLTSNALGLSRAWDKATLRIVSKARAGGLVEGRRLTKVLGLPGPHRRTQRSVRALLTGYLLYTLGGDKTYRRFADPDLQLPKTDPIDPEAPPITPGEKIVTLLK

SEQ ID NO: 604 - protein, 264 aa, Mycobacterium tuberculosis
VLDLEPRGPLPTEIYWRRRGLALGIAVVVVGIAVAIVIAFVDSSAGAKPVSADKPASAQSHPGSPAPQAPQPAGQTEGNAAAAPPQGQNPETPTPTAAVQPPPVLKEGDDCPDSTLAVKGLTNAPQYYVGDQPKFTMVVTNIGLVSCKRDVGAAVLAAYVYSLDNKRLWSNLDCAPSNETLVKTFSPGEQVTTAVTWTGMGSAPRCPLPRPAIGPGTYNLVVQLGNLRSLPVPFILNQPPPPPGPVPAPGPAQAPPPESPAQGG

SEQ ID NO: 605 - protein, 303 aa, Mycobacterium tuberculosis
MERFDGLRPARLKVGIISAGRVGTALGVALQRADHVVVACSAISHASRRRAQRRLPDTPVLPPLDVAASAELLLLAVTDSELAGLVSGLAATSAVRPQTIVAHTSGANGIGILAPLAQQGCIPLAIHPAMTFTGSDEDISRLPDTCFGITAADDVGYAIGQSLVLEMGGEPFCVREDARILYHAALAHASNHIVTVLADALEALRAALSGGELLGQQTVDDQPGGIVERIVGPLARAALENTLQRGQAALTGPVARGDAAAVADHLAALADVDAALAQAYRINALRTAQRAHAPADVVEVLTA

SEQ ID NO: 606 - protein, 462 aa, Mycobacterium tuberculosis
VPRAASAMAEPAMGVGRRRCWPGGRPGMRGCLRGEFGRTAYPAKPCGNRRTGATRGLTSPGYSQAMTVLSRGARVRRGGRRPGWVLLTALLVLAIGASSALVFTDRVELLKLAVLLALWAAVAGAFVSVLYRRQSDVDQARVRDLKLVYDLQLDREISARREYELTLESQLRRELASELRAPAADEVAALRAELAALRTSLEILFDADLEHRPALGTVEKEARAARALDGESPPADWVSSDRVMAVRGGDGASRTDEASIIDVPEVGVPPVSGGPRHYEAPPPPQPEPLFEPRHRPPPLPPQQERPVWQPVTSHGQWLPAETPGSQWASVEPETTPAAPPPGRRRRARHASPADQAYNPPAYVELAAQYGESGRRSRHSAEHRDHDIGGSGAGTGERPPSPPMAPPPPAEPTRRHRTADTPPDDSGGLHARDPLTGGQSVADLMARLQVESTGGGRRRRRGE

SEQ ID NO: 607 - protein, 158 aa, Mycobacterium tuberculosis
MGPTRKRDLTAAVVGAAAVGYLLVAVLYRWFPPITVWTGLSLLAVAVAEALWARYVRVKISDGEIGDGPGWLHPLVVARSLMVAKASAWVGALVTGWWIGVLAYFLPRRSWLRAAAEDTTGTVVAAGSALALVVAALWLQHCCKSPQDPTEHADGAES

SEQ ID NO: 608 - protein, 184 aa, Mycobacterium tuberculosis
VDLPGNDFDSNDFDAVDLWGADGAEGWTADPIIGVGSAATPDTGPDLDNAHGQAETDTEQEIALFTVTNPPRTVSVSTLMDGRIDHVELSARVAWMSESQLASEILVIADLARQKAQSAQYAFILDRMSQQVDADEHRVALLRKTVGETWGLPSPEEAAAAEAEVFATRYSDDCPAPDDESDPW

SEQ ID NO: 609 - protein, 103 aa, Mycobacterium tuberculosis
MTENLTVQPERLGVLASHHDNAAVDASSGVEAAAGLGESVAITHGPYCSQFNDTLNVYLTAHNALGSSLHTAGVDLAKSLRIAAKIYSEADEAWRKAIDGLFT

SEQ ID NO: 610 - protein, 392 aa, Mycobacterium tuberculosis
MSRAFIIDPTISAIDGLYDLLGIGIPNQGGILYSSLEYFEKALEELAAAFPGDGWLGSAADKYAGKNRNHVNFFQELADLDRQLISLIHDQANAVQTTRDILEGAKKGLEFVRPVAVDLTYIPVVGHALSAAFQAPFCAGAMAVVGGALAYLVVKTLINATQLLKLLAKLAELVAAAIADIISDVADIIKGTLGEVWEFITNALNGLKELWDKLTGWVTGLFSRGWSNLESFFAGVPGLTGATSGLSQVTGLFGAAGLSASSGLAHADSLASSASLPALAGIGGGSGFGGLPSLAQVHAASTRQALRPRADGPVGAAAEQVGGQSQLVSAQGSQGMGGPVGMGGMHPSSGASKGTTTKKYSEGAAAGTEDAERAPVEADAGGGQKVLVRNVV

SEQ ID NO: 611 - protein, 94 aa, Mycobacterium tuberculosis
MTINYQFGDVDAHGAMIRAQAGSLEAEHQAIISDVLTASDFWGGAGSAACQGFITQLGRNFQVIYEQANAHGQKVQAAGNNMAQTDSAVGSSWA

SEQ ID NO: 612 - protein, 114 aa, Mycobacterium tuberculosis
MNWIQVLLIASIIGLLFYLLRSRRSARSRAWVKVGYVLFVLAGIYAVLRPDDTTVVANWFGVRRGTDLMLYALVMAFSFTTLSTYMRFKDLELRYARIARALALEGAQAPEQCR

SEQ ID NO: 613 - protein, 192 aa, Mycobacterium tuberculosis
VSQLSFFAAESVPPAVADLSGVLAGPGQIVLVGCGARLSVVVAESWRASALAEMIQEAGLVPEVARTDENTPLVRTAVDPLLCGIAAEWTRGAVKTVPPRWLPGPRELRAWTLAAGSPEADRYLLGLDPHAPDTHSPLASALMRVGIAPTLIGTRGTRPALRISGRRRLSRLVENVGEPPDGAEAWVQWPRT

SEQ ID NO: 614 - protein, 256 aa, Mycobacterium tuberculosis
VTVDPLAPLMELPGVAAASDRVRDALSRVHRHRANLRGWPVAAAEASLRAARASSVLDGGPARLHDAGAPTSGKPALSDPVFAGALRVGQALEGGAGPVVGVWRRAPLQALARLHMLAAADQVDDDRLGRPRSDADVGPRLELLADVVTHPTLASAPVVAAVAHGELLTLRPFGCADGVVARAVSRLVTIATGLDPHGLGVPEVIWMRQPAEYHDAARRFAGGTPDGVAGWLLLCCGAMLDGAREALSIAESLSPG

SEQ ID NO: 615 - protein, 232 aa, Mycobacterium tuberculosis
LQTAHRRFAAAFAAVLLAVVCLPANTAAADDKLPLGGGAGIVVNGDTMCTLTTIGHDKNGDLIGFTSAHCGGPGAQIAAEGAENAGPVGIMVAGNDGLDYAVIKFDPAKVTPVAVFNGFAINGIGPDPSFGQIACKQGRTTGNSCGVTWGPGESPGTLVMQVCGGPGDSGAPVTVDNLLVGMIHGAFSDNLPSCITKYIPLHTPAVVMSINADLADINAKNRPGAGFVPVPA

SEQ ID NO: 616 - protein, 172 aa, Mycobacterium tuberculosis
VSKIDRKNGVPSTLTTIPLADPHAGPAEPSIGDLIKDATTQMSTLVRAEVELARAEITRDVKKGLTGSVFFISSLVVGFYSTFFFFFFVAELLDTWIWRWVAFLLVFAIMVVVTAVLALLGFLKVRRIRGPRQTIASVKETRTALTPGHDKTPVTPKPVTSDRATPVDPSGW

SEQ ID NO: 617 - protein, 386 aa, Mycobacterium tuberculosis
MSVTPKTLDMGAILADTSNRVVVCCGAGGVGKTTTAAALALRAAEYGRTVVVLTIDPAKRLAQALGINDLGNTPQRVPLAPEVPGELHAMMLDMRRTFDEMVMQYSGPERAQSILDNQFYQTVATSLAGTQEYMAMEKLGQLLSQDRWDLIVVDTPPSRNALDFLDAPKRLGSFMDSRLWRLLLAPGRGIGRLITGVMGLAMKALSTVLGSQMLADAAAFVQSLDATFGGFREKADRTYALLKRRGTQFVVVSAAEPDALREASFFVDRLSQESMPLAGLVFNRTHPMLCALPIERAIDAAETLDAETTDSDATSLAAAVLRIHAERGQTAKREIRLLSRFTGANPTVPVVGVPSLPFDVSDLEALRALADQLTTVGNDAGRAAGR

SEQ ID NO: 618 - protein, 214 aa, Mycobacterium tuberculosis
MRIAAAVVSIGLAVIAGFAVPVADAHPSEPGVVSYAVLGKGSVGNIVGAPMGWEAVFTRPFQAFWVELPACNNWVDIGLPEVYDDPDLASFNGATTQTSATDQTHLVKQAVGVFASNDAADRAFHRVVDRTVGCSGQTTAIHLDDGTTQVWSFAGGPSTGTDEAWTKQEAGTDRRCFVQTRLRENVLLQAKVCQSGNAGPAVNVLAGAMQNTLG

SEQ ID NO: 619 - protein, 133 aa, Mycobacterium tuberculosis
MQPGGDMSALLAQAQQMQQKLLEAQQQLANSEVHGQAGGGLVKVVVKGSGEVIGVTIDPKVVDPDDIETLQDLIVGAMRDASQQVTKMAQERLGALAGAMRPPAPPAAPPGAPGMPGMPGMPGAPGAPPVPGI

SEQ ID NO: 620 - protein, 147 aa, Mycobacterium tuberculosis
MGQVSAASTILINAEPTATLDALADYETVRPKILSPHYSEYQVLEGGKGRGTVAKWRLQATQSRVRDVQVNVDVAGHTVIEKDMNSSMVTNWTVAPAGPGSSVTVKTTWTGAGGVKGFFEKTFAPLGLKKIQAEVLSNLKTELEGDA

SEQ ID NO: 621 - protein, 254 aa, Mycobacterium tuberculosis
MGRKVAVLWHASFSIGAGVLYFYFVLPRWPELMGDTGHSLGTGLRIATGALVGLAALPVVFTLLRTRKPELGTPQLALSMRIWSIMAHVLAGALIVGTAISEVWLSLDAAGQWLFGIYGAAAAIAVLGFFGFYLSFVAELPPPPPKPLKPKKPKQRRLRRKKTAKGDEAEPEAAEEAENTELAAQEDEEAVEAPPESIESPGGEPESATREAPAAETATAEEPRGGLRNRRPTGKTSHRRRRTRSGVQVAKVDE

SEQ ID NO: 622 - protein, 166 aa, Mycobacterium tuberculosis
MQRPAADTPDGFGVAVVREEGRWRCSPMGPKALTSLRAAETELRELRSAGAVFGLLDVDDEFFVIVRPAPSGTRLLLSDATAALDYDIAAEVLDNLDAEIDPEDLEDADPFEEGDLGLLSDIGLPEAVLGVILDETDLYADEQLGRIAREMGFADQLSAVIDRLGR

SEQ ID NO: 623 - protein, 100 aa, Mycobacterium tuberculosis
VPGSVPGKAPEEPPVKFTRAAAVWSALIVGFLILILLLIFIAQNTASAQFAFFGWRWSLPLGVAILLAAVGGGLITVFAGTARILQLRRAAKKTHAAALR

SEQ ID NO: 624 - protein, 666 aa, Mycobacterium tuberculosis
VGLWFGTLIALILLIAPGAMVARIAQLRWPVAIAVGPALTYGVVALAIIPYGALGIPWNGWTALAALAVTCAVATGLQLLLARFRDLDAEALAVSRWPAVTVAAGVLLGALLIGWAAYRGIPHWQSIPSTWDAVWHANTVRFILDTGQASSTHMGELRNVETHAPLYYPSVFHGLVAVFCQLTGAAPTTGYTLSSLAASVWLFPVSAAVLTWRAVRSHPGALWSASCASAEWRAAGAAGTAAALSASFTAVPYVEFDTAAMPNLAAYGIAVPTMVLITSTLRHRDRIPVAVLALVGVFSLHITGGIVVALLVSAWWLFEALRHPVRSRLADLLTLAGVAAMAGLVMLPQFLSVRQQEDIIAGHAFPTYLSKKRGLFDAVFQHSRHLNDFPVQYALIVLAAIGGLILLVKKIWWPLAVWLLLIVMNVDAGTPLGGPIGGVAGALGEFFYHDPRRIAAATTLLLMLMAGVALFATVMLLVAAAKRLTDRFRPQPVSVWASATATLLIGATLVSAWHYFPRHRFLFGDKYDSVMIDQKDLDAMAYLASLPGARDTLIGNANTDGTAWMYAVAGLHPLWTHYDYPLQQGPGYHRFIFWAYGRNGESDPRVLEAIQVLRIRYILTSTPTVRGFAVPDGLVSLETSRSWAKIYDNGEARIYEWRGTAAATHS

SEQ ID NO: 625 - protein, 178 aa, Mycobacterium tuberculosis
VRKRMVIGLSTGSDDDDVEVIGGVDPRLIAVQENDSDESSLTDLVEQPAKVMRIGTMIKQLLEEVRAAPLDEASRNRLRDIHATSIRELEDGLAPELREELDRLTLPFNEDAVPSDAELRIAQAQLVGWLEGLFHGIQTALFAQQMAARAQLQQMRQGALPPGVGKSGQHGHGTGQYL

SEQ ID NO: 626 - protein, 643 aa, Mycobacterium tuberculosis
MPSRRKSPQFGHEMGAFTSARAREVLVALGQLAAAVVVAVGVAVVSLLAIARVEWPAFPSSNQLHALTTVGQVGCLAGLVGIGWLWRHGRFRRLARLGGLVLVSAFTVVTLGMPLGATKLYLFGISVDQQFRTEYLTRLTDTAALRDMTYIGLPPFYPPGWFWIGGRAAALTGTPAWEMFKPWAITSMAIAVAVALVLWWRMIRFEYALLVTVATAAVMLAYSSPEPYAAMITVLLPPMLVLTWSGLGARDRQGWAAVVGAGVFLGFAATWYTLLVAYGAFTVVLMALLLAGSRLQSGIKAAVDPLCRLAVVGAIAAAIGSTTWLPYLLRAARDPVSDTGSAQHYLPADGAALTFPMLQFSLLGAICLLGTLWLVMRARSSAPAGALAIGVLAVYLWSLLSMLATLARTTLLSFRLQPTLSVLLVAAGAFGFVEAVQALGKRGRGVIPMAAAIGLAGAIAFSQDIPDVLRPDLTIAYTDTDGYGQRGDRRPPGSEKYYPAIDAAIRRVTGKRRDRTVVLTADYSFLSYYPYWGFQGLTPHYANPLAQFDKRATQIDSWSGLSTADEFIAALDKLPWQPPTVFLMRHGAHNSYTLRLAQDVYPNQPNVRRYTVDLRTALFADPRFVVEDIGPFVLAIRKPQESA

SEQ ID NO: 627 - protein, 336 aa, Mycobacterium tuberculosis
MAKNSRRKRHRILAWIAAGAMASVVALVIVAVVIMLRGAESPPSAVPPGVLPPGPTPAHPHKPRPAFQDASCPDVQMISVPGTWESSPQQNPLNPVQFPKALLLKVTGPIAQQFAPARVQTYTVAYTAQFHNPLTTDNQMSYNDSRAEGTRAMVAAMTDMNNRCPLTSYVLIGFSQGAVIAGDVASDIGNGRGPVDEDLVLGVTLIADGRRQQGVGNQVPPSPRGEGAEITLHEVPVLSGLGLTMTGPRPGGFGALDGRTNEICAQGDLICAAPAQAFSPANLPTTLNTLAGGAGQPVHAMYATPEFWNSDGEPATEWTLNWAHQLIENAPHPKHR

SEQ ID NO: 628 - protein, 627 aa, Mycobacterium tuberculosis
MVRVSLWLSVTAVAVLFGWGSWQRRWIADDGLIVLRTVRNLLAGNGPVFNQGERVEANTSTAWTYLLYVGGWVGGPMRLEYVALALAMVLSLLGMVLLMLGTGRLYAPSLRGRRAIMLPAGALVYIAVPPARDFATSGLESGLVLAYLGLLWWMMVCWSQPLRARPDSQMFLGALAFVAGCSVLVRPEFALIGGLALIMMLIAARTWRRRVLIVLAGGFLPVAYQIFRMGYYGLLVPSTALAKDAAGDKWSQGMIYVSNFNRPYALWVPLVLSVPLGLLLMTARRRPSFLRPVLAPDYGRVARAVQSPPAVVAFIVGSGVLQALYWIRQGGDFMHGRVLLAPLFCLLAPVGVIPILLPDGKDFSRETGRWLVGALSGLWLGIAGWSLWAANSPGMGDDATRVTYSGIVDERRFYAQATGHAHPLTAADYLDYPRMAAVLTALNNTPEGALLLPSGNYNQWDLVPMIRPSSGTAPGGKPAPKPQHAVFFTNMGMLGMNVGLDVRVIDQIGLVNPLAAHTERLKHARIGHDKNLFPDWVIADGPWVKWYPGIPGYIDQQWVTQAEAALQCPATRAVLNSVRAPITLHRFLSNVLHSYEFTRYRIDRVPRYELVRCGLDVPDGPGPPPRE

SEQ ID NO: 629 - protein, 165 aa, Mycobacterium tuberculosis
MVAVQSALVDRPGMLATARGLSHFGEHCIGWLILALLGAIALPRRRREWLVAGAGAFVAHAIAVLIKRLVRRQRPDHPAIAVNVDTPSQLSFPSAHATSTTAAALLMGRATGLPLPVVLVPPMALSRILLGVHYPSDVAVGVALGATVGAIVDSVGGGRQRARKR

SEQ ID NO: 630 - protein, 637 aa, Mycobacterium tuberculosis
MSELAASLLSRVILPRPGEPLDVRKLYLEESTTNARRAHAPTRTSLQIGAESEVSFATYFNAFPASYWRRWTTCKSVVLRVQVTGAGRVDVYRTKATGARIFVEGHDFTGTEDQPAAVETEVVLQPFEDGGWVWFDITTDTAVTLHSGGWYATSPAPGTANIAVGIPTFNRPADCVNALRELTADPLVDQVIGAVIVPDQGERKVRDHPDFPAAAARLGSRLSIHDQPNLGGSGGYSRVMYEALKNTDCQQILFMDDDIRLEPDSILRVLAMHRFAKAPMLVGGQMLNLQEPSHLHIMGEVVDRSIFMWTAAPHAEYDHDFAEYPLNDNNSRSKLLHRRIDVDYNGWWTCMIPRQVAEELGQPLPLFIKWDDADYGLRAAEHGYPTVTLPGAAIWHMAWSDKDDAIDWQAYFHLRNRLVVAAMHWDGPKAQVIGLVRSHLKATLKHLACLEYSTVAIQNKAIDDFLAGPEHIFSILESALPQVHRIRKSYPDAVVLPAASELPPPLHKNKAMKPPVNPLVIGYRLARGIMHNLTAANPQHHRRPEFNVPTQDARWFLLCTVDGATVTTADGCGVVYRQRDRAKMFALLWQSLRRQRQLLKRFEEMRRIYRDALPTLSSKQKWETALLPAANQEPEHG

SEQ ID NO: 631 - protein, 237 aa, Mycobacterium tuberculosis
MWSTVLVLALSVICEPVRIGLVVLMLNRRRPLLHLLTFLCGGYTMAGGVAMVTLVVLGATPLAGHFSVAEVQIGTGLIALLIAFALTTNVIGKHVRRATHARVGDDGGRVLRESVPPSGAHKLAVRARCFLQGDSLYVAGVSGLGAALPSANYMGAMAAILASGATPATQALAVVTFNVVAFTVAEVPLVSYLAAPRKTRAFMAALQSWLRSRSRRDAALLVAAGGCLMLTLGLSNL

SEQ ID NO: 632 - protein, 449 aa, Mycobacterium tuberculosis
MLDAPEQDPVDPGDPASPPHGEAEQPLPGPRWPRALRASATRRALLLTALGGLLIAGLVTAIPAVGRAPERLAGYIASNPVPSTGAKINASFNRVASGDCLMWPDGTPESAAIVSCADEHRFEVAESIDMRTFPGMEYGQNAAPPSPARIQQISEEQCEAAVRRYLGTKFDPNSKFTISMLWPGDRAWRQAGERRMLCGLQSPGPNNQQLAFKGKVADIDQSKVWPAGTCLGIDATTNQPIDVPVDCAAPHAMEVSGTVNLAERFPDALPSEPEQDGFIKDACTRMTDAYLAPLKLRTTTLTLIYPTLTLPSWSAGSRVVACSIGATLGNGGWATLVNSAKGALLINGQPPVPPPDIPEERLNLPPIPLQLPTPRPAPPAQQLPSTPPGTQHLPAQQPVVTPTRPPESHAPASAAPAETQPPPPDAGAPPATQSPEATPPGPAEPAPAG

SEQ ID NO: 633 - protein, 342 aa, Mycobacterium tuberculosis
VIQVCSQCGTGWNVRERQRVWCPRCRGMLLAPLADMPAEARWRTPARPQVPTASDTRRTPPRLPPGFRWIAVRPGAAPPPRHGPRLRGPTPRYAGIPRWGLTDHVDQAPVPASAKAGPSPAAVRTTLLVSLLVFSIAVVVFVVRYVLLVINRNTLLNSVVASASVWLGVLVSLAAIAAAGTTIVLLVRWLVARRAAAFMHQGLPERRSARELWAGCLLPMVNLLWAPLYVIELALVEDRYTRLRRPIVVWWIVWIVSNAISMFAFATSWVTDAQGIANNTTMMVLAYLCAAAAVAAAARVFEGFEQKPVERPAHRWVVVNTDGRSAPASSVAVELDGQEPAA

SEQ ID NO: 634 - protein, 177 aa, Mycobacterium tuberculosis
MGTGSGGPIGVSPFHSRGALKGFVISGRWPDSTKEWAQLLMVAVRVASLPGLLSTTTVFGAREELPDEPEPGTVGLVLAEGTVFGESAIQPGYFADHQPPALLMLHPPSETTPSLPECTGAASGCVLLPGLPYLGLEHRAAWVEAEADGTITSMVSRVGVDPISHPDTAILAMLLAA

SEQ ID NO: 635 - protein, 132 aa, Mycobacterium tuberculosis
MSTTFAARLNRLFDTVYPPGRGPHTSAEVIAALKAEGITMSAPYLSQLRSGNRTNPSGATMAALANFFRIKAAYFTDDEYYEKLDKELQWLCTMRDDGVRRIAQRAHGLPSAAQQKVLDRIDELRRAEGIDA

SEQ ID NO: 636 - protein, 218 aa, Mycobacterium tuberculosis
MGLFGKRKSRATRRAEARAIKARAKLEAKLSAKNEARRIKAAQRAESKALKAQLKARRDSDRAALKVAEAELKVAREGKLLSPTRIRRLLTVSRLLAPILTPVIYRAAMAARGLIDQRRADQLGVPLAQIGRFSGHGARLSARVGGAERSLRMVQEKKPKDVETKQFVSAVTNRLTDLSAAVAAAEHMPAKRRRTAHSAISSQLDGIEADLMARLGLT

SEQ ID NO: 637 - protein, 183 aa, Mycobacterium tuberculosis
MVDPPGNDDDHGDLDALDFSAAHTNEASPLDALDDYAPVQTDDAEGDLDALHALTERDEEPELELFTVTNPQGSVSVSTLMDGRIQHVELTDKATSMSEAQLADEIFVIADLARQKARASQYTFMVENIGELTDEDAEGSALLREFVGMTLNLPTPEEAAAAEAEVFATRYDVDYTSRYKADD

SEQ ID NO: 638 - protein, 480 aa, Mycobacterium tuberculosis
MGLRLTTKVQVSGWRFLLRRLEHAIVRRDTRMFDDPLQFYSRSIALGIVVAVLILAGAALLAYFKPQGKLGGTSLFTDRATNQLYVLLSGQLHPVYNLTSARLVLGNPANPATVKSSELSKLPMGQTVGIPGAPYATPVSAGSTSIWTLCDTVARADSTSPVVQTAVIAMPLEIDASIDPLQSHEAVLVSYQGETWIVTTKGRHAIDLTDRALTSSMGIPVTARPTPISEGMFNALPDMGPWQLPPIPAAGAPNSLGLPDDLVIGSVFQIHTDKGPQYYVVLPDGIAQVNATTAAALRATQAHGLVAPPAMVPSLVVRIAERVYPSPLPDEPLKIVSRPQDPALCWSWQRSAGDQSPQSTVLSGRHLPISPSAMNMGIKQIHGTATVYLDGGKFVALQSPDPRYTESMYYIDPQGVRYGVPNAETAKSLGLSSPQNAPWEIVRLLVDGPVLSKDAALLEHDTLPADPSPRKVPAGASGAP

SEQ ID NO: 639 - protein, 100 aa, Mycobacterium tuberculosis
MAEMKTDAATLAQEAGNFERISGDLKTQIDQVESTAGSLQGQWRGAAGTAAQAAVVRFQEAANKQKQELDEISTNIRQAGVQYSRADEEQQQALSSQMGF

SEQ ID NO: 640 - protein, 666 aa, Mycobacterium tuberculosis
MAADYDKLFRPHEGMEAPDDMAAQPFFDPSASFPPAPASANLPKPNGQTPPPTSDDLSERFVSAPPPPPPPPPPPPPTPMPIAAGEPPSPEPAASKPPTPPMPIAGPEPAPPKPPTPPMPIAGPEPAPPKPPTPPMPIAGPAPTPTESQLAPPRPPTPQTPTGAPQQPESPAPHVPSHGPHQPRRTAPAPPWAKMPIGEPPPAPSRPSASPAEPPTRPAPQHSRRARRGHRYRTDTERNVGKVATGPSIQARLRAEEASGAQLAPGTEPSPAPLGQPRSYLAPPTRPAPTEPPPSPSPQRNSGRRAERRVHPDLAAQHAAAQPDSITAATTGGRRRKRAAPDLDATQKSLRPAAKGPKVKKVKPQKPKATKPPKVVSQRGWRHWVHALTRINLGLSPDEKYELDLHARVRRNPRGSYQIAVVGLKGGAGKTTLTAALGSTLAQVRADRILALDADPGAGNLADRVGRQSGATIADVLAEKELSHYNDIRAHTSVNAVNLEVLPAPEYSSAQRALSDADWHFIADPASRFYNLVLADCGAGFFDPLTRGVLSTVSGVVVVASVSIDGAQQASVALDWLRNNGYQDLASRACVVINHIMPGEPNVAVKDLVRHFEQQVQPGRVVVMPWDRHIAAGTEISLDLLDPIYKRKVLELAAALSDDFERAGRR

SEQ ID NO: 641 - protein, 511 aa, Mycobacterium tuberculosis
LSAPAVAAGPTAAGATAARPATTRVTILTGRRMTDLVLPAAVPMETYIDDTVAVLSEVLEDTPADVLGGFDFTAQGVWAFARPGSPPLKLDQSLDDAGVVDGSLLTLVSVSRTERYRPLVEDVIDAIAVLDESPEFDRTALNRFVGAAIPLLTAPVIGMAMRAWWETGRSLWWPLAIGILGIAVLVGSFVANRFYQSGHLAECLLVTTYLLIATAAALAVPLPRGVNSLGAPQVAGAATAVLFLTLMTRGGPRKRHELASFAVITAIAVIAAAAAFGYGYQDWVPAGGIAFGLFIVTNAAKLTVAVARIALPPIPVPGETVDNEELLDPVATPEATSEETPTWQAIIASVPASAVRLTERSKLAKQLLIGYVTSGTLILAAGAIAVVVRGHFFVHSLVVAGLITTVCGFRSRLYAERWCAWALLAATVAIPTGLTAKLIIWYPHYAWLLLSVYLTVALVALVVVGSMAHVRRVSPVVKRTLELIDGAMIAAIIPMLLWITGVYDTVRNIRF

SEQ ID NO: 642 - protein, 115 aa, Mycobacterium tuberculosis
VSMDELDPHVARALTLAARFQSALDGTLNQMNNGSFRATDEAETVEVTINGHQWLTGLRIEDGLLKKLGAEAVAQRVNEALHNAQAAASAYNDAAGEQLTAALSAMSRAMNEGMA

SEQ ID NO: 643 - protein, 462 aa, Mycobacterium tuberculosis
MRNPLGLRFSTGHALLASALAPPCIIAFLETRYWWAGIALASLGVIVATVTFYGRRITGWVAAVYAWLRRRRRPPDSSSEPVVGATVKPGDHVAVRWQGEFLVAVIELIPRPFTPTVIVDGQAHTDDMLDTGLVEELLSVHCPDLEADIVSAGYRVGNTAAPDVVSLYQQVIGTDPAPANRRTWIVLRADPERTRKSAQRRDEGVAGLARYLVASATRIADRLASHGVDAVCGRSFDDYDHATDIGFVREKWSMIKGRDAYTAAYAAPGGPDVWWSARADHTITRVRVAPGMAPQSTVLLTTADKPKTPRGFARLFGGQRPALQGQHLVANRHCQLPIGSAGVLVGETVNRCPVYMPFDDVDIALNLGDAQTFTQFVVRAAAAGAMVTVGPQFEEFARLIGAHIGQEVKVAWPNATTYLGPHPGIDRVILRHNVIGTPRHRQLPIRRVSPPEESRYQMALPK

SEQ ID NO: 644 - protein, 802 aa, Mycobacterium tuberculosis
VTALQLGWAALARVTSAIGVVAGLGMALTVPSAAPHALAGEPSPTPFVQVRIDQVTPDVVTTSSEPHVTVSGTVTNTGDRPVRDVMVRLEHAAAVTSSTALRTSLDGGTDQYQPAADFLTVAPELDRGQEAGFTLSAPLRSLTRPSLAVNQPGIYPVLVNVNGTPDYGAPARLDNARFLLPVVGVPPDQATDFGSAVAPETTAPVWITMLWPLADRPRLAPGAPGGTVPVRLVDDDLANSLANGGRLDILLSAAEFATNREVDPDGAVGRALCLAIDPDLLITVNAMTGGYVVSDSPDGAAQLPGTPTHPGTGQAAASSWLDRLRTLVHRTCVTPLPFAQADLDALQRVNDPRLSAIATISPADIVDRILDVSSTRGATVLPDGPLTGRAINLLSTHGNTVAVAAADFSPEEQQGSSQIGSALLPATAPRRLSPRVVAAPFDPAVGAALAAAGTNPTVPTYLDPSLFVRIAHESITARRQDALGAMLWRSLEPNAAPRTQILVPPASWSLASDDAQVILTALATAIRSGLAVPRPLPAVIADAAARTEPPEPPGAYSAARGRFNDDITTQIGGQVARLWKLTSALTIDDRTGLTGVQYTAPLREDMLRALSQSLPPDTRNGLAQQRLAVVGKTIDDLFGAVTIVNPGGSYTLATEHSPLPLALHNGLAVPIRVRLQVDAPPGMTVADVGQIELPPGYLPLRVPIEVNFTQRVAVDVSLRTPDGVALGEPVRLSVHSNAYGKVLFAITLSAAAVLVTLAGRRLWHRFRGQPDRADLDRPDLPTGKHAPQRRAVASRDDEKHRV

SEQ ID NO: 645 - DNA, 82993 bp, Mycobacterium tuberculosis
aagcttttcgacccgcaagccggcggtgcccctcctcgttccgctgcccggtctgctcgatcggttcggggtcgccgcgctaggcccaattgcccggctcctcctcgggccgttccacgacccgcatcgtcgccgggctaggttcaagccatgccggtagaccccaggacgccagtgctgatcggctatggacaggtcaaccaccgaggcgacatcgacgccgagaagcagtccatcgaacccgtcgacctgatggccgccgcggcccggaaagccgcggattcgacggtgctcgaggcggtggattcgatccgtgtggtgcacatgctgtcggcgcattaccggaatcccgggcagctcctcggcgaacgaatcaaggcgaggaccttcaccaccggttacagcggggtgggcggcaacatgccgcaatccctggtcaaccgggcatgcctggacatccagcgcgggcgggccggcgtggtgctgctggctggcgccgaaacctggcgcacccgaacgggcctgcgcgccaagggcagcaaactggagtggactgtgcaggacgaatccgttccgctgccggacatggccggcgacgacgttccgatggccggtgcggctgagctgcggatcaacctggaccggccggcctacgtgtacccgatattcgagcaggcgctgcgcatcgcctacggcgagtcgatcgagaaccaccgaaagcggatcggcgagctgtgggcgcggttcagtgccgtagctgctgacaacccgcacgcgtggatccgcaacccggttacggctgacgagatctggcagcccggcccacagaaccggatggtcagctggccctacaccaagcttatgaactccaacaacatggttgaccagggtgccgcgctgctgctgacgtcggtcgaacgtgcgacacgtctgcgaataccggccgaacgctgggtttatccacaggctggcaccgacgcccacgacacaccggccgtcgccgaccgccaccgactgcatcggtcgacggccattcggatcgccggtgcccgggcgctggaactggctgggctggggctcgatgacatcgaatacgtcgacctgtattcgtgctttccctccgctgtccaagtcgccgcaatcgaactcggcctggacaccgacgatcctgcccgcccgctgaccgtcaccgggggcctgaccttcgccggcgggccgtggagcaattacgtcacgcactccatcgccaccatggctgaactgctggcggccaatcccgggcgccgaggcctgatcaccgccaacggcggttacctgaccaaacacagtttcggggtctacggcaccgagccgccgtcggaattccgctgggaggacatgcaacccgcggtcgatagggagcccaccggagatgggttggtcgagtgggaaggcatcggcaccgtcgaagcgtggaccacaccagtcaaccgggacggacaacccgagaaggcgttcctggcggtgcgcacgcccgacgggtcgcgcagcttggccgtgatcaccgatcccgcatcggtgcaagcaacggtgcgcgaggacatcgccggcgtcaaggttgccgtcgcccccgacggcaccgcgaccctgcgatagccggcgggcagcacgagtcacgttccagaagcaatggtcgcgcaagcgacactgacgtgcctattgtcatgaggagacgttgggggaggtgaggccgggtgcagatcctggttaccgacgccacgggtgccgtcgggcggtcggtcactcggcagttgatcgctgccggacacacggtgagcggtatagcccagcacccgcacgatgctctggacccccgcgtcgactatgtttgcgcgtcgttgcgcaacccagtgctgcaagagttagccggcgaagccgacgcggtgatccatctcgccccggtcgacaccagcgccccgggcggtgttggcatcaccggactggcacatgtggccaacgcggccgcccgcgccggtgcccggctgctgttcgtttctcaggccgctgggcgacccgaactatatcggcaggctgagacgctggtgtccaccggttgggcacccagcttggtcatccgtattgcgccaccggtcggccgccaactcgattggatggtgtgccggacagtggccacgctgctgcggagcaaagtctcggcacggccgatacgagtgctacatctcgacgacttggtccgcttcctggttttggcgctgaataccgaccgcaacggtgtcgttgacctggccacccctgacaccaccaatgtggtcaccgcgtggcggctgctccgatccgtggacccgcacttgcgaacacgtcgggtccgcagctgggagcaattgattcccgaggtggatatcgctgccgtgcaggaggattggaacttcgagttcggctggcaagcgaccgaagcaattgtcgacaccgggcggggcctcgtcggccgcagactgcacccggcaggcgcgaccaacggatcgggtcaactagcactgccggtggaggcgcccccgcggtctgtgccttcccacggggaacccttgggcagcgcggctccagaagggttggagggagagttcgacgaccgtatcgacgagcggttcccggtcttcagctcggccagtctcgccgaagcgctgccgggtccgctgaccccgatgacgctggatgtccagttgagtggactgcgcgcggccggtcgggcgatgggtcgggtactggcgcttggcggtgtcgttgccgatgagtgggagagaagagccatcgcggtgttcggtcaccgcccgtatatcggagtgtcggccaatattgtggccgccgcccaactgccggggtgggacgcgcaggccgtagcccggcgggcactgggcgagcaaccgcaggtcactgagctgcttccgtttggtcgaccgcaacttgcgggcggaccgctcggctcggtcgcgaaggtggtcgtgacggcgcggtcgctggccctgctgcgccatctccggagcgacacacaccactatgttgccgccgcagatgccgagcacctcgctgccgggcagcttgcctcgctaccggacgccggcttggaggtccggattcggctgttgcgtgatcgcatccaccaaggctggattcttacggtgctgtgggtgatcgacacgggcgtcacagcggcgacgttagagcacacccgcgcaggctccgcggtgtccggagggggcatgatcatggaaagtggcagaatcggcgccgagattgctccgctggctgcggtgctgcgcgccgacccgccgctgtgcgcgctggccaacgacggcaacctcgccagcatccgcgcgctgtctgctcccgccgccgccgcagttgacgcggtcattgcccggatagggcaccgcgggttaggcgaagccgagctggctaacctgacgtttgccgacgatccggcgctactgctgaagacagccgccgaaatcgccgcgcggcccgccgggccagctcacccagcgacgttgatccagcgactggctgccggcacgcgcagtgcccgggagctggcgcacgacaccaccatccgattcacccatgagctccggatgacattgcgggagttgggatctcgacgagtcgcggcggatgtgatagacgtcgttgacgacgtgttctacctgacctgcgacgaactgattaccacgccggccgacgctcggctgcgaatcaaacgtcggcgcgccgaacgagaacgcctgcaggcacagcgcccgccagacgttatcgatcatgcctgggtacccgtggagtagcggtcaacacacgtcaattcgtcgtcaggtccgccaacggccactgcggatcaaccagcctgtcaacgtcgaccgggttcccggaccggatcaggcccttgacgtcgtccaccacgtcccagacgttgacattcatcccggctagcacccggctgtcgccgtcgagccagaaggagaggaactcgcggccggcaacgttgccacggaacaccacccgatcacagctgggggcgtggccgacgtactccatgccgaggtcgtattgatcggtgaacaaatagggcagttcagcgtattcgcccggccggcccagcatgccggcagccgccaccgcgggttgtttgagcgcgttggcccagtgttcggtacggacgcgggtacccaatagcgggtgttcagcggcggcaatgtcgccgactgcgtagatgtcgggatcgctggtgcgcagcgatgcatcaaccaacacaccgccctcgcccatcgccagcccggcctgttgggcgagttctacgttgggcttcgcgcccacagcgactagcacggcgtcggcggcaaccgtcgacccgtcacgcatcttgagcccggtcgccttgccgtcggctgcagtgatctcttcgagctgggtctgcaaccgtaagtccaccccttgatctcgatgtaggtcggcaaacactttgccaaccgcttccccgagcgcggccagcagcggttgtatggcggtctcgacgacggtgacgtcgacgccacgttgacgcgcactggcggccacttccaggcctatccagccggcacccaccactgcgagggaagacccctgcaccagaacggagttcaatgccacggcgtcgttgtagctgcgcaggtagtggacgccggcggcatcggatccaggtattggtgggcgccgtggggccgatcccgtggccaacagcagcttgtcgtagcgcaccgcagcgccgtcgggaagctctaccgtgtgtgcggaccgatccaatgacgacacccgcacgccgagccgcacatccacgtcatggtcgcggtaccaatcggaggtctggatggtgaagtcgctcagcgactttttgccggccagaaactccttggaaagcggcggccggtcgtagggcaggtgctcttcgtcgccgaacaagataatccgaccgccgaagtcgctgcggcgcaacgcctctacggctttagccccggcaagtcccccgccaacaatgacgaacgtggttgagctggccataattgctgctccgtcctgttgtgtgcggtgccgcttgacagcctacgagccggtcgcgtacctgggtcaaccggtcacctgcaggcgcagctcgtcgtcttacgccactcgcactaacgcagcagcgagcagcgcattggagctgggtgccaccgacgccagcttcttcgggtcagtgggcaagccgagctgcttcgccgcggcggtggctcgatcgtcgaaatacggtcgtacccagatccagacgtcttggacctcgcgtaagaaaatgtcggcaccggtgtcgccgattccgttgaaagtcttgagcatacgtttggcggccgaaacgtcgggtcgtgtgcgctgggcgagttcccgcaaatcaccggagtactcgtcgcgaacccggtgagcgatagcggtgagccgggtggctgagctctcgtcataccgcacgtagtgggcacggccaaacgcactgatcatcgtttgtcgctctgctgacagcacagctttgggtgtccgcaggcccgagcagaacaattcccgggcggcacgtgctgccgtggcggcaccgatcggcttgctggccagcatgcacagcaccagcagctgaaacagcggcatcggtttgtccctgatccggattcccgcctccgccgcgtaagtggtgccggcgagtttaagcagtcgtcgtgccagtggctccggcttgatcacaagcaaccgcatacccgcaatgcgtggcggcaaaccgcgactattgctcgggcaagcgcgctccggcggcctaagccccggttccggccaacccctgtcagtccaaatccacccggatggtcagcaagtcggtgcccatcgcgcgtacgccggcactgttcagccggggtaggccgcgcagccgctgcctcggatcgtcgtcgggtagcaggtaggcggtcccactgcgccatcggccgccgatgcggacccgcacggcggggttggccttgatgttgtagacgtaatcggaatgctcgccgtgctcggacaccatccagaactggttgtctacgacgcgcccgcccaccgcggtacgccgcggctgtcccgttttgcggccgatggtttcgagcatggtcatcggcagttgccggccgattggattgaccacgaaccgttgcacgcgatggacgaattcccgcttgagattcatagctgcattcaacgctaccgatctggccgcggcctcacgttggtgccccgatagggccgagccgccgcagttgtgtcacgtgccgaggtgacagctcctcaaggcaggtcacgcccagtagccgcatggtccggatcacacctgtctgaaggatctcgatcgcgcggttgacgcccgcctcaccaccggccatcagcccgtaaaggtaggcccgcccgatcagcgtgcaccgtgcccccaacgcgatcgccgcgacgatatcggcgcccgacatgatgccggtgtccaccaggatttcggtgtgtttgcccagttcgcgtgccacgtggggcaacaggtggaagggtaccggggctcggtcaagctggcggccgccgtgattggacaacacgatgccgtcgacgccgcggtccaccacggcgcgggcgtcgtcgagtgtttggatccctttgacaacgagcttgcccggccactgcgacttgatccaggccaaatcgtcgaaggtgaggctggggtcgaacacggtgttcaagtactcgccgacggtgccaggccagcgatccagtgaagcgaaggccagcggttcggtggtcaacaagtcgaaccaccaccgcgggtgtcccatcgcgtcgagaacggttcgcagcgtcagcgccggcgggatggacatcccgttgcggacatcgcgtagccgggcaccggcgaccgggacgtcgaccgtgaccagcatggtgtcaaatcccgcggcggcgacgcgccgcaccaatgccatcgagcggtctcgatcacgccacatatacagctggaaccatttgcggccctgcggcacagcgatgacgaggtcttcgatggcacaggtggccagggtggatagcgaaaacgggatcccagccgcggccgccgcccgcgcgccggcgatctcgccctcggtgtgcatcaagcgggtgaacccggttggcgcgatcccgaatggcaagacggtgggctgaccgaggacgttccagccggcgcacacggtggtgacgtcacgcaggattgtcgggtgaaactcgatgtcgcggaacccttgtcgagcacgcgcgatggacagttcgtcctcggcacccccgtcggcgtagtcgaacgccgccctaggggtacgccgtttggcaatgcgtcgcaggtcctggatggtcagcgcggcgcccaggcggcgcttggaggtgtcgaactgcggcctgttgaactggagcaggggtgccagatcgcgcactctgggcactcgccggttgaccgccatccgtttatctaaccagtttgatatgaagtcagcaagcgacccgttcgacctgaagcgtttcgtgtacgcgcaggctccggtctaccgcagcgtcgtcgaggagctgcgcgccggacgaaagcgcggtcattggatgtggttcgtcttcccacaactccgcgggctaggtagtagcccactggcagtgcgctacggcatctcctcgctcgaggaagcccaggcctatctgcagcatgacctgctcgggccccgcttgcatgagtgcaccgggttggtcaaccaggtgcaaggccgctcaatcgaggaaatcttcggcccgcccgacgacctcaagctgtgctcgtcgatgaccctgttcgcccgtgccaccgacgccaaccaggactttgtcgcgctgctcgccaagtattacggcggcggagaggaccggcggacggtggcattactggcggtcacatagaccgcgcgatccaccggggcgtcgacgcctgacagcggatgtaggttcgggctcatggagaaggtgatcgccgtgctcatgcggcccgagccagacgacgactggtgtgcccgccaacgagctcaagtcgccgacgccctgctgggactgggcgttgctgggctgtcgatcaatgtccgggacagtaccgtgcgcgactcactgatgaccctgacaacgctgtacccaccggtcgcagcggtggtcagcctgtggacccagcagtgctatggcgagcaggtagcagccgccctcaggctactggctcaggagtgtgatgaactcggcgcatacctggtgaccgagtcggttccgctgaccttcccatcgctcgtcgagtccggttctcgtacaccgggtctggccaacatcgcgctcctgcgccggcccgatggcctggaccaggcgacctggctgacccgctggcagcgcgaccacacgcaagtggctatcgaggcacaggcgacattcggctacacccagaactgggtggtacgagccctcaccccagaggcaccgggaatcgcgggcattgtcgaagagttgtttcccgtggcggcgacaaccgatctgaaagccttcttcggagccgccgacgacaacgatctgcggaatcggataagccggatggtcgcgagcacatctgcattcggtgccaaccagaacatcgacaccgtgccaaccagccgctacgtgttcagaacaccgttcaaggattgaggaacgtgagatgacaacactcaacgaagccgcggcactggcggcggcagaacgtgggcttgcggtggtttccaccgttcgtgccgacggcaccgtgcaggcgtcgctggtcaacgttggactgttgccgcatcctgtcagcggcgaaccatctctgggattcaccacctatggcaaggtcaaactcggcaaccttagggcgcgcccacaactggccgtcacgttccgcaacggttggcagtgggcgaccgtcgaaggccgagcacaacttgtcggccccgacgatccgcggccgtggctggtcgacggcgagcgattgcggctgctactccgcgaggtcttcactgcggcgggtggcacgcacgacgactgggacgagtacgaccgggtgatggcgcaggagcagcgcgccgtggtgctgatcacgcccacccgcatctacagcaacggctgagggactcagcaaacggcgtcgctcgtgcgacctgcggggtcgagttgggttgggttgagtcgggcggctgcgatgatagctcgcagtgtgcgccggcagcgtccgcagtcgccgccagccccgcacacagcggccacttctttggaggtcgacgcacctcgcgccacggcgtcacacacggtttggttggtgacgccgacgcacaagcacacgtacatcagcaaacccccagcagatgctgcgtcggcgaacgatcaagccgcatattagtggagtctagcctaagctgattagtggagtctaacctaacaatgacccgcggcttggactttgcgccggcgagacgcgccgacgccgcaacaaaccctgcgccgacccgtactcgctgcactagattgagacgcggcacgcaaacgtgctgttatcagcccaagacgagcccgacaccggtgcgctccagccctgcccacctggcgcggttcgccacgacagccttatatcccataggagtggtcatgcaaggtgatcccgatgttctgcgcctgctcaacgaacaattgaccagcgagctcaccgctatcaaccaatactttctgcactccaagatgcaggacaactggggttttaccgagctggcggcccacacccgcgcggagtcgttcgacgaaatgcggcacgccgaggaaatcaccgatcgcatcttgttgctggatggtttgccgaactaccagcgcatcggttcgttgcgtatcggccagacgctccgcgagcaatttgaggccgatctggcgatcgaatacgacgtgttgaatcgtctcaagccaggaatcgtcatgtgccgggagaaacaggacaccaccagcgccgtactgctggagaaaatcgttgccgacgaggaagaacacatcgactacttggaaacgcagctggagctgatggacaagctaggagaggagctttactcggcgcagtgcgtctctcgcccaccgacctgatgcccgcttgaggattctccgataccactccgggcgccgctgacaagctctagcatcgactcgaacagcgatgggagggcggatatggcgggccccacagcaccgaccactgcccccaccgcaatccgagccggtggcccgctgctcagtccggtgcgacgcaacattattttcaccgcacttgtgttcggggtgctggtcgctgcgaccggccaaaccatcgttgtgcccgcattgccgacgatcgtcgccgagctgggcagcaccgttgaccagtcgtgggcggtcaccagctatctgctggggggaactgtcgtggttgtggtggctggcaagctcggtgatctgctcggccgcaacagggtgctgctaggctccgtcgtggtcttcgtcgttggctctgtgctgtgcgggttatcgcagacgatgaccatgctggcgatctctcgcgcactgcagggcgtcggtgccggtgcgatttccgtcaccgcctacgcgctggccgctgaggtggtcccactgcgggaccgtggccgctaccagggcgtcttaggtgcggtgttcggtgtcaacacggtcaccggtccgctgctggggggctggctcaccgactatctgagctggcggtgggcgttttggatcaacgtgccggtttcgatcgcggtgctgacagtggcggcaaccgccgtccctgcgttggcccgaccgcccaaaccggtcatcgactaccttgggatcctggtcatcgctgtggccacgaccgctttgatcatggccacaagttggggcggaaccacctacgcctggggctcagcgaccattgtcgggctgttgatcggggccgcagtggcgctgggtttcttcgtgtggctggagggccgcgccgctgcggccatcctgccgcccaggctgtttggcagcccagtatttgccgtgtgctgcgtcctgtccttcgtggtcggattcgcgatgctgggtgcactgaccttcgtaccgatctatctggggtacgtggacggcgcgtcggcgaccgcgtcaggtctgcgcacgttgccgatggtgatcggcctgctgatcgcctcgaccgggacgggtgtcctggtcggccggacgggccgctacaagatcttcccggtcgcggggatggcgctgatggcggttgcgttcctgctgatgtcgcagatggacgagtggacgccaccgctgctgcaatcgctgtacctggtcgtcctaggtgccggcatcggattgtccatgcaggtgctcgttctcatcgtgcagaacacgtcgtctttcgaagacctcggcgtcgcaacatcgggtgtgaccttcttccgggtggtcggcgcctcgtttggtaccgcaacattcggtgcgttgttcgtaaacttcctggaccgaagactcggttccgcgctgacgtcgggcgccgtgcctgtcccggcagtgccatctccggctgtcttgcatcagctgccccagagcatggccgccccgatcgtgcgggcatatgccgagtcgctcacccaggtgttcctttgcgcggtctcggtcacggtggtcggtttcatcctggcgctgttgctgcgagaggtaccgctcaccgacatccacgatgacgccgacgacctcggcgacgggttcggtgtgcccagagccgaatcgccggaggatgtgttggaaatcgcggttcggcgtatgctgccgaacggggtgcgactgcgcgatattgcgacacaacccggttgcggactcggcgtcgccgagctgtgggcccttctgcggatctatcaataccagcggctgttcgaggcagtacggctgaccgatatcggtagacacctgcacgtgccctatcaggtctttgaacccgtcttcgaccgtctggtccagaccggctacgcggcacgcgacggcgacatcttgacgctaaccccgtccgggcaccgtcaggtcgactccctcgcagttttgatccgtcagtggctgctcgaccacttggccgtggcgcccggcttgaagcgacagccagaccaccaattcgaagccgctctgcagcacgtcaccgacgcggtgctcgttcaacgagactggtatgaagatctgggcgacctgtcggaatcacgccaactcgcggctacaacgtagcgatgcttgccgcgcgtagccgcgcgagctgatccgcgctgcagaatgactgccatgacagccacaccgcttgccgcggccgcgatcgcccaattggaggcagagggcgtcgacaccgtcatcggcaccgtcgtgaaccccgccggactcacccaggccaagaccgtgccgatacgccggaccaacacattcgccaatcctggcctcggcgccagtccggtgtggcataccttctgtatcgaccaatgcagtattgcattcaccgcagacatcagtgtggtcggcgatcaacgtctccgcatcgatctgtccgccttgcgcatcatcggcgacgggttggcgtgggcgcccgccgggttcttcgagcaggacggcacaccggtccccgcctgcagccgaggaacactgagccggatcgaggccgcgcttgctgatgccggcatcgacgcggtaatcggccacgaagtcgaattcctcttggtcgacgcggacggccagcggctgccttcgacgctgtgggcgcagtacggtgtcgccggggtgctcgagcacgaggcgttcgtccgcgatgtcaacgccgcggcaacggcagcaggcatcgctatcgagcagttccatcccgaatacggtgccaaccaattcgagatctcgttagcgccgcagccgccggtcgcggccgccgatcagctggtgctgacccgcctcatcatcggccgtaccgcccgccggcacgggttacgcgtgagcctatcgccagcgcccttcgccggaagtatcggatccggtgcccaccaacacttctcgctgactatgtcggaagggatgctgttctccggtgggactggagcagctggcatgacctcggccggggaggccgcggtggcaggagtgcttcgcggactaccggacgcccaaggcatcctgtgcggatcgatcgtgtccggtctgcgaatgcgacccggtaactgggccggaatctatgcatgctggggtaccgaaaaccgggaagcggcggtgcgattcgtcaagggcggggctggcagcgcgtacggcgggaacgtggaggtgaaggtcgtcgacccgtcggccaacccgtatctcgcgtcggcggcgatcctcggactggcactcgacggcatgaagaccaaggcggtgttgccgtcggaaacgaccgtagacccgacacagctgtctgacgtggatcgtgaccgtgccggcattctgcgacttgctgccgatcaggcggatgcaattgctgtactggatagttcgaaactgcttcggtgcatccttggcgatcccgtggtagatgccgtggtcgcggtacgccagttagagcatgagcgctacggtgacctcgatcctgcgcagctggccgacaagttccggatggcttggagtgtgtaacgatggccgactccgccggttcggacctgacgcggcacacggccgaagtgccgttgatcgatcagcacgtccacggatgctggctgaccgaggggaaccggcggcggttcgagaacgcgctcaatgaggccaacaccgaacccctggcagacttcgactcgggattcgactcacaactcgggttcgccgtgcgcaaccactgcgctcccatccttggattgcctaggcacgttgatccgcagacttattgggatcgccgcagtcaattcagtgaagctgaattggctcgcagatttctgcaggccgccggggtaaccgactggctggtggagaccggaatcggctacgacgtgtccggaatggcaagcgtcgccggcctcggcgaactgtcgggcagccacgctcacgaggtggttcgtcttgaacaggtggccgaacaggccgtgcaggcatccggcgactacgcctcggcgttcaacgagatactgcgccggcgcgcagccacagcggtggcaaccaagtccatcctggcctatcgaggtggattcgacggtgatctgaccgagccacccgcggcgcaggtcgccgaggccgccaagcgctggcgcgaccgtggcggtgtccgattacaggatcgggttctgctgcgcttcgggttgcatcaggcgttgcgcctgggcaagccgctgcagttccacgtcggatttggcgaccgggacgctgatctgcacaaggccaatccgctgtatctgctcgacttcctgcggcagtccggcaataccccaatcgtgttgctgcactgctatccctacgaacgagaagccggttatctggcacaagccttcaacaacgtctatcttgacggcgggttgagtgtgcactacctgggggcccggtcgccggccttcatcggccgactactggagcttgcccccttccgcaagatcgtgtactcgtcggacggattcggccccgcggaactgcactttctcggtgcaacgttgtggcgcagtggaattcagcgtgttctgcgtggctttgtcgagcgcgacgactggtgcgagaccgatgccctgcgggtggtcgacctaattgcccatggcactgccgcacgcatctatcgccttggcgatcggtagctttcaggtggcgcaagtgtggccccgtcacgggctaaccatggaccgtgccggacccagtgtcaccggcagcgtcgaccaaccgcgcagcacccgcgtgtcacgccgacttccggcacccgcggcccgcacatcggggaagcggtcgaagaacgttctcagcccgacctcgccttcggcgcgggccagggcggcccccaggcagaagtggcggccggtagagaacgcaagatgtcgtccggcattggggcgttcgatgtcaaagcggtgcggatccgggaacacagcgggatcgcggttggcggctgctaggtagatcaccacgacttcgccgcgtttgattcgcacaccagccacctcgacgtcacggcaagccacccgggcggtgagctgaaccggcgaatccagccgcaggatttcttcaaccgtattcggccacagctccggatgttggcgcagtgtggccagatgttcgggggtatccaacaacatgcgaatcccgttgcctaacaggttcactgtggtttcgaatccggcgaccaaaaccagtccggcgatcgcccgaagttcggtctcgtcgagctgtgtctcgttgtccccgctttcggcgatctggatcaactgactcatcaggtcgtcacccggagcgtgccgcaactgctgcagatgcccttccagccagcagtcgaatcctcgtatcccctgctgcacacgcaggtactgccgccacggaatcccgatgtctagactcggcgctgccaactcaccaaattccaggacgcgcggcctgtcatgctcgggcacgcccaaaatttcgctgatgaccacgatcggcagttgcgagcaatagcgtcctacgacgtccacaatcccgggctgctcagcgaaccgatccaagagattgatcgcggtctgttcgaccagatcgcgtagcgcgctgaccgcccgtgaggtgaacaccgccgacaccgttttgcggtagcgagtgtgatcgggcggctcgacggccagcagcgaaggttctcgcagggggtgaagttgatcgccgcgggtccgccgctccagccagcgcagcggtggtggcagattctcgccgaaggagacgacgcggaagtcgtccgatcgcagcaggtcatgggcgagccgatggtcgacggtcaggtagttggcgcggttgcgcaccagggcgccgtgggaccggacttcgtcgtaaaagggcaccggatcggtggcgacggccggatccgcgatcagccgggcctgcaagtcgccacgccgaatcccgattgccgcaatgccgcggatcaccccgtgcatcgccaaccagtgcagcttgtccttcaccgcgcctccgtcgatcgagtggcttttcttcaagactagaacccgcaattcaacattcggcgaggatgttgaagtctgttgacaccaccgtgttgggttttttgctgctgatgccgtaggcactgccggcaactgtgtatgtgttgcgggcgcggtcggcgcgggcgttgcccaccccgccgtgccagaagctgccgttgaacccgtcgacgttacggatcttcacccactgcgggattaccctgtcaccgctgagcaataccacggcttggacggtgctgtcgtggttgcggatgtcgatggtccggtaggagtgctcctggctgcatgttgcgggacgtgtcgtgtgagtgacgccgtcaatagtcaggcgtgcggcttttcggggtaccgtctgagcttgcccgcacgcggagagaccagccgcgacgaccattgcaactccggtcactgtgaccaaccgattgcacaccagccacctccattcgggcctgagcattgtgctcgggacattacttccgttttggctccaacgtggccagggacttggcaatgtgacgtcggacgaactccggactgacgcccttgagccgatcaatccagcgaatgcttcggggcacataccaatgcaaccgtgtggggtgctggtaggcccgccaggctgcctcggcgacgctggacgagggcatcagccggaacatgcccttcttgggcgcggcagcgcggatctgctccgcggagatcgtgtaggggccctcgtcggaatgctggcgcgtcgaggtgaggatagcggtgtcgatcagaccgggcagcacgtcggcgacgcgaaccccatgacgctgccactcaacgctcaacgcctcggtcaaccccttgacggcgtgtttggtcgccgagtagaccgcgatacgcggcatgccataggtgcccgaggacgacgacgtcgagaacatcagacttcccggtgctttcttgaggtaaggcagtgcggcgtaggcgccagtgagcaccgccttgaagttcacgtcgacgacgcgcacggcggcctcgtacggcacgtcctcgaaccaaccgccttcgccgatgccggcgttgttccacatcatgtcgagaccgccgccgacattgccggcgcagaaatcagcgagcgcaccctcaagggccgccttgtccgtaacgtcgacggcgcgggcccacagccgttcggcaccaagctgtacgcgcagggcagccagcccatcctcattgcggtctatcgcacctactcgccagccgttggcgtggaaaagcgttgcaccctcgcggcccattccactgccggcgccggtgatgaatatcgctttcatgcggaatccggaatagccgaaccgccctcagcctgcttcaaccagatctttgatgcgctgcaacgtcttggtcatgtctcggatgttgcggcgctgacgcagccagcccccgaacacccggtagtacacggtggtcaacacggacggggggagccgaaacgactcagtgacctcggtgccgtcggcggtgggcgtcaaacgataatgccaattgttcaccggtctgtcgccgagcagcacagcaaacccgaactcacggcccggttcgcataccgtccagtagaccggcccgatcccgttgcgccggacatgcccgcggaatcgagcgccaagcgcggggccggtggcaccgtcaagccactcggcctcgaaggtttccggcgagaaccggccggtattgcggacatccgcgatcaatgtccagatcttgtccggcggcgctgccatgtgaactgtggccgaaccttccatgacctgatccaaacacatacgtcgacctggtcatagaccgcacacgccgccaaccgtcagcgcggaatacttgcctgaatgcctgcccaaatgatctcgttgatgatttgcttgatgccctgcgcgggtttcgaccacagtgcgatcggaaggccagaggcggcgccgcacgtcggccacgcgtccaatccctgttcggcgagaacccgattggcaactgcgatttgttgttcccgagaggcagctgctgggttgccgacaccgccgaatgcggcccaggtggccggcttgaactgcagtccgccgtatttgccgtttccggtgttggccgcccagttgcccccggattcgcactgcgcgacggcgtcccagttcgggctgggaccggcgtgggcaacggcggtggagagcgacatggatgccgtgacgagtcctgcggccatggcggacttgatgagcggcttggcgattcttgtcatgctcgacatatcgccggaagtggccgaagcgttaccgattagagagagtggtgagatcgggtgtctattgcaccgcgaccggccgtggtcggccggcaaaggatgcacaaccggattgatcaggccggcggtagggcctggcaatacgactgtgttgctgtcgtcagggcccgttgatagaggctatcgaggtggcgggaccgcactatgtcgcgtttggcgcggtcgagttgggcggcgcaggacggcgcggacagcaaactccagtgactccaaatctgcgacagcatccgattattcagggagtcgatcgccgatcgcgatgccgatagatccggcggctccgggggcgcgctggccgggttgagcttccagtccgagaaccggctgtactcgattgcctcggtggcgcgaatctggtcgtcgaagacgcgggtgacgtagtcggggtcgatgtgctgcgagcgggcatcttcgcccaactttgcgagttgctgttcgactcggccggaatcctcaatgggcagctgagcacgccacttgaaggctgccaccgggtcggcgacctccaaccgctcagcggcggcgtcgaccaactcggctaactggctggtgccgtcggctcgcgccagcggggggcctagtggtgcaatcagcgacaacaggatgccgatcgagacggcggtcgcgaggtatatctcacgtggacgggtaagcaacccttcggttgatcccgtcagccggcgcctaacgaactctgcaggtcacccttcatggcgttgagctgagcgccccagtactcccagctgtgcgtgccgttgggcgggaagttgaacacggcgttgtgcccgcccgcggcgttgtacgcatcctggaacttcaggttgctgctacgaacgaagttctccaagaactcggcgggtatgttggcaccgcccaactcgttcggggtgccgttcccgcaataaacccatagccgggtgttgtttgcgaccagcttggggatctgctgcgtagggtcgttgcgctcccatgccgggtcactcgagggaccccacatgtctgcggccttgtaaccgccggcgtcacccatcgcgaggccgatcaggctaggccccatcccctgagaggggtccagcagggccgacagcgagccggcgtagatgaactgctgggggtggtaggcggccaagatcattgccgacgagccggccatcgacaagccgattgcagcgctgccggtgggcttcacggccctgttggcggacaaccattgcggcagctcgctggtcaggaaggtttcccacttgtaagtctggcagccagccttaccgcaggccgggctgtaccagtcgctgtagaagctggactgcccgccgaccggcatgactatcgacagtcccgactggtagtaccactcgaacgccggggtgttgatatcccagccgttgtagtcgtcttgggcgcgcaggccgtcgagcagataaaccgcaggtgagttgttcccaccgctctggaactgaaccttgatgtcgcggcccatcgacggcgacggcacctgcaggtactcgaccggcagccccggccgggagaacgcgcccgcggttgccgctccgccggcaagccccaccaggcccggaaggactacagccgctgccgtgccgatcatcaatcggcgtccccaagctcgaatctttcggctcacgtctgtcatacttgtgcccctttgtcctgtatgtcgtcgtgtgctcgggccagaacataccgtgtgtggaggccaaatgtcgattcgggcgcaaagtcgtctcatttccgtatcggttaccgccgcggacagagcaagtgtgcttagggggctcacaaacggtatggcggtatggatctatcgcggatttctcagaatcgcggcccggggctaccggctgtgctcccccagggaggccgaacttgcgttcaccgcgtaggctcgctcgaagcaagccgacgaagaccacgctatcccggtctgttccggcgtccgcgtaacaccgcactggggtttgtggcgtgcgatggtgcgggctgagggcatcggaggttccgggaacgattgaggtgcgagaatttggacacggtacttgggctctcgataacgcctaccaccctggggtgggtcctcgctgaaggacacggcgcagacggcgccatcttggaccgcaacgaattggagctacatagcggtcgtaacgcgcaggccatacataccgcagagcagctggcggcggaagttctgctcgcccatgaagtggccgctgcaggcgatcatcggttgcgcgtcatcggagtgacctggaacgccgaagcttcggctcaggcggcgctgctggtagagtcgctgaccggtgcaggtttcgacaatgtggtgccggttcggcggctacgtgccatcgagacactggcgcaggctatcgcacccgttatcggctacgagcaaatcgcggtatgcgttcttgagcatgagtcggcgaccgtcgtcatggtcgacacccacgacggaaagacgcagatcgccgtcaagcatgtgtgccgcggattatcaggactgacctcctggctgaccggcatgtttggtcgcgatgcctggcgcccggccggcgtggtcgtggtcggctcggatagcgaggtcagcgaattctcgtggcagctcgaaagggtcctgccggtgccggtctttgcgcaaacgatggcgcaggttacggtcgcgcggggtgcggccctggcggcggcccagagcaccgagttcaccgatgcgcagctagtggccgacagcgtcagccaaccaacggtcgcgcccaggcgatcccggcactacgccggggcggcggcagcgttggccgccgcggccgtgaccttcgtggcttcgctgtccctagcggtgggcatccagctggctccgcacaacgataccgggacggcgaagcacggagcgcacaagccgacgccacgtatcgcaaaggccgtggcgccggcggtgccgcctccgccgacggtcacgccaccagtccctgctcgggcaccccggccggctgcgcagcacgaaccacccgctcgcgtcacctccggcgaagcgctcacggagccgaacccgcctgaggagcaaccgaatgcttctgcgccgcaacaggatcggaatgacagccagccgatcactcgagtgctagagcacatacccggcgcttacggtgactcggcacccccagctgagtagtcggaggccgccgtagccggttgcgaaacctgttcgcgcggacccatgtcgaggcgaagcggtgggtactcgtcgcgcatcagcgtggtgtatgcgcggacccgcaacgcccaccggtttacaggttgtatagccctatggggtaccggccggtgaacaggagcgccaccacggcgacgagcagcaggatcaccagtagcgaaggccacattatgccgacgcggtcgtgggggtcgatcaggaagactcgccaaccgctggagaggaagaccgccaggatcaggtagtgggggatagcaagtagccaccacttaatcagcaccaggccgcggctcaaccgctccggatagtcaacctccaagtcagccggatactccgcctttgtctgcaggctgaagggcgggtaccggtcggttcccagcgccgacagcgcatagaaggcaacccgccagcgccaccgcatgacgccgacattgaagtcgaacagcgtccggggatatctgcccgtgaacaggatggcaaagaacgcgatcacggtgaccaccacggcggcaacgtgcaagaagaacaagacaatgtagtgcgggatggccaaaaaccacttgactagccactgccaacgtgacaacgcaggatcgaggtcaccccggacccggactggataggcgtcaggttgcatgatcgacggctcctttacatgcgcgtcggctcgatccacgagccaggcccattgtctctcatctgccgcgcatgggcgaagccatcgtcgtgcgctacggacaccggatcgacgtgcagtaatagccttgggctgtaggcagctttccgggcgatgacggcggcactggtaatccattgtcggccaacaatttactgagaggggtcggtacagattgccagccgtggctatccaggtacgtggcaacgtcgttgcgctcgccgtcgctgtatagcaggttgggtgatttctatgtcgaacccgtggacgctccagcgctgcgaagcggtgtcaaggaggtcggatgccggtccgccatcgtcatctaccgactccccggcgcgctgagcgcggtgatgttgtccagcaagcgatcctgagcgtcgggcggcaggaatgccagcaggccctcggcgagccaggcactgggttggttggggtcaaagcccgcttggcgcaacggggtcggccagtcacgtctgaggtcgacgggaaccacgcgaggtcagctgttgcagtggcatccagatcagcaagtgtcgtcatcggtatgcgcgcgcgtcaagacctgaggccaggatgacagcctgccgaatccccgcagacgtcgcgtcacggaaaaacgcatcgaagtaccgcgtccgggcggccaacaggtcggccaatcgctgcagtccccacgtgccgtcggggtcgtcgacgtcggtcgccttgatgtttccggcggcccagcgagtgaagaagtcaatccccacggctctcaccagtggttcggcgaacggatcatcgatcagcgggttatcggccctggtggccaccgcgcgggcggcagccaccatcgtcgccgttgctccgacgctagttgccaggtcccacgcgtcgttgttggtgcgcggcatcgggatcctttcggctcggccagcgatatacagccttcgaagtccaccgcttgtgggatcaatcgtcctttgcccgaaccgcggtgaatgccacgctcacttcgtcggcgacccgtattgaacccatcaacagcgagtagggtttgacgccgtagttggactggcgaaccgtggtgtcggcagagatgcgccacgcagcaccaagatcctctgtgtgcaagtcgatgacgtgttctcgcgactttccccggatgtgcagtttcccggtcaggcggtacccattcccggtctgggcaatggcttccgtggtaaagcgaatatgggggaagcggctggcgttgagcgttttcagcgcgttcgcccgcaccagagctttctcaggctcggacagccccttcacgccaccctcaccgcgcatcacctcgaaggaatccacctcagccacaagctcgccggcgacgggatcggtgccggaccagttcaccagggcctgccaccgtgtcatcgcgatggtcaggcgatgacccaagcgcgcggctctgccaacgactccggtgcgaagtaccagctcgccgtcggaagcatcaagagtccacaccgcgtcgctcacgccacgactgtattcagacgacctgcctgcccgcccctcccgccgcgtcttgtgggccacgacacaatcgttatgcttggtgaggctcgccggtgccgttggaggggtgcaacatgattcgcgaactggtcaccaccgctgcgatcacgggtgccgcgatcggtggggcgccagtcgcgggcgcagacccgcagcgttatgacggcgatgtgccggggatgaactatgacgcttcgctgggcgccccatgctccagctgggagcgcttcatttttggacgaggcccctccggtcaggccgaagcctgtcattttccgcctcctaaccagttcccgccggccgaaaccggctactgggtgatctcctacccgctatacggcgtccagcaggtcggtgcgccgtgtccgaagccgcaggcggccgcgcagtctccggatgggttgccgatgctgtgtctgggagcccgtggatggcagccgggatggtttaccggggccgggttcttccctccggagccataaccggtgggcgtttctcatgatcatgtgcgaaggccggcccaccgaatcaccgatcccacggtggctgcgcttcgtgcttacgtctgaccgtgccggctcggcatggtatatcggggcaggcttcttcttcgcgccagtgctggcggtgctttcgccatggccgaccatcaccgcggtgctgtggtggatcatcggactggcgggactatggctcggactgctcggaatcgcgatggcagtcggactggcccgggtgttgcgttccggcgccgaaataccggaagcctactggcgcacgctggtcgactaccgatccgccaacgaataggagactccgatgagcttcaatcccaaagatgcggtcgacgctgtccgggacattgcggccaatgccgtcgagaaggcctcggacatcgtggaaaacgccggccacatcatccgcggcgacatcgctggcggggccagcggcatcgtcaaggactccatcgacatcgccacccacgcggtcgacagaacgaaagaagtgttcaccggcaagacggacgacgaaggttagtcgagactagtcggcgcgcgcttgtcgtccgttgtcaaacggacgcggcagcattgagtgcgtccaaccgggcggtcgcctcgaggtactcctgcacccagcgttcgataacggtagccgtcttttccaccttggtgaactgcccaacaacctgccccaccgggttgaacgcgacgtcgacggtctcgttcgggtatttatgtgtggctttgacggccatgccggagaccatgtattgcaacggcataccgagcggcttcgggctctccggttgctcccaggcctcagtccagtcgttgcgcagcatccgggccggcttacccgtgaaggaacgactgcgcacggtgtcgcggctggtcgccttgacgtatgcggcctgttgaaccgcggtgtttgcggcttcctcgaccatcagccactgcgaaccggtccatgccccttgggtccccagcgccaacgctgcagcgatctgctgaccgctgccgatgccacccgccgccaacaccggaaccggcgctacctccttgacgacctgaggccacaacacaatggagcccacctcgccacagtgcccgccggcctcgccgccctgggcgatgatgatgtcgacgcccgcatcggcgtgcttgcgggcctgcgagggtgagccgcacaatgcggccaccttgcgacccgagtcgtggatgtgcttgatcatgtccgctgggggggtgccaagcgcgttggcgaccatcgtcatcttggggtgcttcagcgccgcgtcgacctgtggggtggccgtcgcctcggtccaaccgagcagctgcagactgtcctcgtcggcgtcctcgaccgggacaccatgatcggcgaggatcttgcgggcgaagtccagatgctcctgcgggaccatcgaccgcagcgtcttggcgagctcatccgccgacagctgggagtccatgccctcgtacttgttcgggatcacgatgtcgaccccgtaggggtggtcgccgatgtgttcatcgatccagttgagctcgatctccagctgctccggcgtgaacccaactgctccgagcacaccaaaaccaccagctttgctgacggcgaccaccacatcgcggcagtgagtgaaggcaaaaataggaaactcgataccgagctcgtcgcaaatggcagtgtgcatgcctgctcctggaatgctagcggacgcaaatagaactgaaacgtgttctagtttagtacccgtcttggtaaggtggccaacagcccaggttccggtcgggtttcggcgcgcaccccggcgaagctgacgaggcggtctaaggtcaccttcacccgcgcatggccggccagcaacaacgacggctgtcccaccgagcagaagtactgggcgatggtgtgcaccgcggtcggctaccaccgcgacgaccccgccgcagaactgctgttacgcaacgaaggcttggcagctgcagtccaaactggccacctacgtctacccgccacagaaactagtcgccaaggtccgtgcgggcgccaaagtgtccgacaaccacgaccaggcgaccactctgttccaccacgcgatcgatcacccaaccgtgaccgtgcagcagacctactccctgatcaaccctcaatcggccccggggcgatggaccttgatccgctggggccccgccggtagcctagtgctgcgaattacgctatgccgagtctcggaattgccggcccgccgttcaccacgttcaaacgcccgagaccggtgccaggcaggtacgcgaacctcatgggtctcaattcgttctgccacaaagaaagtgagtaagccagcatgcgtgcggtagtcatcgacggggccggcagcgtcagagtcaacacccagcccgacccggcactgcccgggcctgacggagtggttgtcgccgtgaccgccgccggcatctgcggatccgatctgcatttctacgaaggcgaatatccgttcaccgagccggtggccctcggtcacgaggcggtaggcaccatcgtcgaggccgggccacaggtgcgcaccgtcggagttggcgacctggtcatggtgtcttcagtggccggctgcggcgtctgcccgggatgcgaaacccatgatccagtcatgtgcttctccggcccgatgatcttcggcgccggcgtgcttggcggcgcacaggccgatctgctggcggtgccggccgccgatttccaggtgctcaagatccccgaaggtatcaccaccgagcaggcactgctgctcacggacaacctcgccaccggttgggcggcagcccaacgagccgatatttcattcggctccgccgtggcggtcatcggcctgggagccgtcggcctctgcgcgctgcgcagcgccttcatacacggtgccgcaacggttttcgctgtcgaccgagtaaagggacgcttgcaacgcgcggccacctggggtgctacgccgataccgtcaccggcggccgagacgattctggccgcgacgcggggtcgcggcgcagactcggtgattgacgccgtcggcaccgacgcctcgatgagcgacgcgctcaatgcggtgcgccctggcggcaccgtctcggttgtcggcgtgcacgatcttcagccgtttcccgtgcccgcactgacgtgcctgttgcgaagcatcacgctgcgaatgaccatggcaccggtacaacgaacctggccggaactgatcccgttgctgcagtcgggccgactcgatgtcgatggcatcttcactaccaccctgccgttggacgaagcggccaagggctatgcaaccgcgagggcgcgctcgggtgaggagctaaggttctgcttacgccctgacagccgtgatgtactgggagcgcatgaaactgtcgatctttacgtccacgtccggcggtgtcagtccgtagccgacctgcagctcgagggtgctgcggacggggtcgacggcccatccatgctcaactagccactccacgggatcggtcttgtcgtcgtaggtgagcgcggagaaattcacgtcaccagacatattgacccccgggtgtgcggtttccagcgcggcgagctgctcgtgatccaaccgggaccctaaggcgcccaaggcaactcggctgccaggcgcacacaactcatcgatccgggcgaacagagcatattgcgcatcgccggtcaggtagggcagtagtccctcgaccgaccaggcgctgggtcgttgcggatcgaacccggccgctgtcagcggcgtgggccagtccgtacgcagatctgctggcaccgccacccggtgagctttgggtacagcaccccgctcacttagcacccgtgctttgaattccaggaccttcggcacatcgatctcgaaaaccgttgtcccgggctgccagtcaaggcgataagcgcggcagtccagaccggcggcgacgatcaccgcctgtcgtatgccagcctcatcagcgcagttgaagaagtcgtcgaaaaaccgggtttgcacgccgtagagccgagggaaagcggtgccgtcctccgacgttctcgggtttgctaacagaccctccagatacgggtcggccgaagcggtgatgaaatgcttcgcgtattcgtcttggaccagcggtttagggcccgtggtgtgcagtgcacgccaacccgcaaccagtagcgcggtgtagcccacgttgctgacaatgtcccagtggtcgtcatcggaacgaagcgagccatactcaggtgtagtcatctcatcagccttccagcattacggtcaccggaccgtcgttgaccagttcgacctgcatgtgggcaccgaacacgccggcttccacgtgcgctcccaactggcgcagcgctgccgcgaacgctgctatcaggggctgcgccaccgcacctggcgccgcggcgttccaggacggtcgccgacccttcgcggtgtctgcgtagagggtgaactggctgattaccaggatcggtgcgtgcatgtcggaggcggatttctcgtcggcgagaacccgcaaattccagagcttttcggcgagacggcgcgccttgtcgagatcgtcgccgtgggtgacaccgacgaacgcgaccaggccctgcccgtccggccggatagcgccgaccacccgaccatcgaccctcaccgcagccgatgagacccgttgcaccagaacccgcacgagcctcgatgctgccaggccggctatgcagtcgctggggctgggtaggctcattgtgtgtctgtgctggtcgcgttttccgtcaccccgctgggcgtgggggagggggtcggcgagatcgtcaccgaagcgattcgcgtggtccgtgattccggcctgccgaaccagacagatgccatgttcaccgtgatcgaaggcgatacctgggcggaagtgatggccgtcgtgcagcgcgcggtggaggccgtggccgctcgggcaccgcgagtcagcgcggtgatcaaggtggactggcgtcccggggtcaccgacgcgatgacccagaaggtcgctaccgtcgagcggtatcttctccggcctgaatagcagcgctaaacgcccgctcggccgcatccccatggaccgcaaataccaccctttgcagcgaccccggccggtgccgacggacggcgccgaccatcagccgcgcagcgtcgtcgagcggaaagccgcccacgcccgtgccgaaagccaccagcgccagcgagcggcaaccgagctcgtcggctttccgcagggtagcagcggtggctgcggtgatgatctcgcccgaggtcggacctcctagctccatcgtcgccgcgtggatcacgtagcgcgccggcatgtcaccggccgtggtctcgaccgcttccccaagcccaatcggcgccttctcggtggactcgcgctgcagctcggggccgccggcgcgggcgatggccgcagcgacaccaccggcatgccgcagtcgggtgttcgccgcattggtgatggcgtcgagctcgagcttggtcacgtcggcctgatgtacctccaactcgatcatcgacacattgtcccccctgcaagtactcggcggccgcggtgatgcaccccttgttgtgttggaccgtcgccaccatcgcccacacaatcgaaccctcgcccggcgccactgcggcccatcgagactccggcccatcgagcccagattcagggtagcttgaggtgaacgaggacaatcaagcggctggcaaggacacagaccgatggctcgtgatccagttgtaccgagggtgcgaacagcatgagtggcgacgacgccgggccgggcgaggtcagccatgcccgcggcgtcggtgggccgggcggagccggaggcgccggtggccggggtggtgccggcggtcgcggcggggcgggcggtagaggcggagatggcggcataggcggggcagcgggccccggcggtcaacccggccagggcggggtgggcggcgcacccggccccggtggaacccccggcgaaccaggtcagcccggcaaaccaggacaaccggggcaacccggcagcccgggacattagcgcgtgcgggtggcgtcgtcgcgcatgagcacgcatagccgccatctgcccggtacgcccttgagttcctgctcaccacgctcggcgaaccggtgccgtgatccggcgacgatgtctcgcacggtcgaggacaccagcacctcactgggtccggccagcgcgcagacgcgcgcaccgatatgcacggccacgccggcgacgtcggtaccgtgcgaggcatcgcgcacctcgacctcgcccgcatgaataccgatccggacctcaatacccagcgcggcgaccgcgtcgacgatgtcgtccgcgcacgcgatcgcggcactcggactggtgaacgtcgcgacgaaaccgtcaccggccgtgttcacttcgcgaccgccgaaccgctggatttcgtggcacacgatggtgtcgtggttgtccaacaggtcgcgccatcggtcgtcgccgagcgcggcggcgtgctgggtcgagccgacgatgtcggtaaacatgatggtggcaagcatgcgctcggcgtcagcgccgccgcgcacgccggtgatgaattcctcgatttcatcgagcatcggcccggtgtcgccaacccagtacagggtatcggtgccgggtagttcgaccaagcgggatccagcgatgtgctcggcgaggtagcgaccatgtcccaccgggatgtacgtcgatccgacacggtgcaagatcagtgttggagcctcgatgtgtcccaagacatctcgtacgtcggcctcggctatgacctttgaaacggcacgggcaatgctcggcggtccggcacggttgccggcgagatcccaccaggctcgaaacacgtcatctccggccacggtaggagccacgatgctcagcacgtcgaagccccgctcgacggcatccggttccagcgccaccgtcaggaacgggtcagctcgacgaacctgggcgcctaccgggtagtcgggcgcccatagtgggcgcgccgagccgttgacgacgatcaggctgcgcacccgctcggggtagtcggcggcgagaacaagtccgttcatggcgtggaaactgggcgcgaaaattgtcgcctgctcgcatccgaccgcgtccatcaccgcgatcgcgtcctgggcccagaacttcggccccagcgtggttatcgcggcgagccgtgacgacaggccgaccccacgatggtcgaggcggatcaccctgctgaatgacgcaagacggcgatggaaacggtacagcgatggctcgtcgtcgatcgagtcgatcggcacgaacggccccggcaacaccagcagatccgtcggaccgtcacccagcacctggtaggcgatatccatgtcgccgcattttgcgtagcgggtcctgtgaatgtggggagcctgcgccacggtcctacgttagttcatgcgtaggctcatggcggtgagcgcacgtgcgggcatcgtgatcaccggaaccgaggtcctgaccgggcgggtccaagaccgcaacggcccctggatcgccgatcggctcctggagctcggggtcgagttggcacacatcacgatctgcggcgaccgtcccgccgacatcgaggcacagctgcgattcatggctgagcagggtgtggacctgatcgtcaccagcggcggcctggggccgaccgccgacgatatgaccgtcgaggtggtggcgcgctattgcgggcgcgagctggtgctggacgacgagctggagaacaggatcgccaacatcctcaagaagctgatggggcgaaatcccgctattgaacccgccaacttcgactccatacgcgccgccaaccgcaaacaggccatgattccggccggatcgcaagtgatcgatccggtgggcaccgcccccggtctggttgtgccgggacggccagcggtgatggtgcttcccgggccaccgcgcgagctgcagccgatatggagcaaggccatccagacggctccggtacaggatgcgattgccggccggacgacctaccgacaggagaccatccggatcttcggcctgccggagtcttctctggccgacacactgcgtgacgccgaggcagccatcccgggttttgacttagtcgagatcaccacctgcctgcggcgcggcgagattgaaatggtcactcgctttgaaccgaacgccgcgcaagtgtacacgcaattggcacggttattgcgcgaccggcacggccaccaggtctattcggaagacggtgcgtccgtggacgagctggtcgcaaaattgctaactggccgccggatagcgaccgccgaatcctgcaccgcagggttgctggcggcacggctcaccgaccggcccgggtcgtccaagtacgtggcgggcgcagtggtggcctactctaacgaggcgaaggcacagcttctcggtgtggatccggcgctgatcgaggcccacggggcggtttccgagccggtcgcccaggcaatggcagcgggggcgctgcaaggcttcggcgccgacaccgccaccgcgatcaccggaattgcgggtccgagtgggggaacgccggaaaagcctgtgggaacagtgtgcttcaccgtcctgctggacgatggccgaacaaccacccgaaccgtgcggctgcccgggaaccggtcagacattagggagcgctcgacgactgtggcgatgcacctgctgcggcgcaccctgagcggtatcccgggctcaccctagcgacggcgaaatcgacagcagcgcgacaaagttcgacgagaagacaccgcgctaatgtcgatttcgatgacgaacaagaaaagcagtttccgtagtaccaaagcggattccggtggcatccttgccaatcgccgtcagcaccgctacgaccaatagcacgggcacgatcgtcgcggccaaggcgaaggggtagccatgggattcggccagacgctcttgaataggaaggttgaacgccgccagcagattaccgagctggtaggttacgccggggtagacgccccggatagcgtctggcgacatctcggtcagatgcgcggggatcacaccccaggcaccctgtacgaagacttgcatcaaaaacgaacccaggcacaacatcgccgcagtgcgcgagtaagcgaacagcggcacgatcggcagtcccagcgccgcacagaaaacgatggtgtaacggcggctgaaccgctgggacaacgtgccgaacgccagaccgccgatgatggcgccgatgttgtagatcaccactatccacctggcggtcaggctggacaaaccggcaccatgatcggtagtcgcggtcaggaaggtcgggtagacatcctgggtgccgtggctcatccagttgaaggcggtcatcaacagcactaggtagacaaaccggcgcacaattgcggggttacccaggacatcgcggattcgggtcttggtgagccgcatgcggtcctgcgcggcttcccagacttcggattcctttacccggtaccggatgatcaagctgatcagagccgggatgatgcttaggccgaacaaccaccgccacgacagccctagccagttcatcaccaccagcgctgccacactggccagcagatagccgaacgcgtagccctcctgcagcagcccggagaagacgccacgccgctcggctggaaccttctccatggacagcgcggcacccagcccccactctccgcccatgccaatgccgtagagcagtcgcaggatcaccagcacggtgaagttgggtgcgaatgcgcacagaaatccgatcaccgaatagaacgacacgtcgaccatcagcgggacccgccggcccacccggtcggcccatagcccgaacagcaacgcacccacggggcgcatggccagggtggcggtggtgagaaacgcgacgtcggtcttggtgtggtggaaggtcgttgcgatgtcggcatagaccagcaccacgagaaagtaatcgaacgcatccatcgtccaacccaagaaagatgccataaaagcgtttcgctggtcgccggtcaaccgcggtgctgccacgtctgcatcgtggcgtaccgggcgcggcaccgcgagtccggggacatggcgaacagcggcggctcgcatgtccgtggcaggatcgggcaatggtgccttttctgatgcgcgccgcagtgaccggattcgcattatgggtggtgactcttttcgtcccgggcatgcggtttgcgggcggcgacacaacgctgcagcgggtcgccatcatcttcgtcgtcgcggtgatcttcggtctggtcaacgcgttcatcaagcccatcgtgcagatcttgtcgatcccgttgtacatcctgactctcggtcttttccatgtagtcgttaacgcgtcgatgctgtggcttaccgcgtggatcactgagcacaccacccactggggactgcagatcgaccacttctggtggaccgcgatctgggcggcgatcttgttgtcgatcgtcagctggatcctgtcgctgttggctcgtgactttcgacgtgtcactcgcgcacactagagccacaaattttggtggggggacatcctaggttttcggggcatgttccacttatgcttactcacactgcttgccaacctcgtccaagacaggcaccctgtcttcggcgtgatgacgctgacctcccgccctccaatacgccggacggcagcacctaacagcacacgacgacgggactgcaaatgatgcgcactgtcgcgattggaccaggtgccggtccttcgagcacacggccgagttcgcaacccagtgacctgcatagcggcctacgcgcggttaccgagtgcaccggctcagcggtggtcgttcatgtgggcggcgacatcgacgccagtaacgaggtcgcttggcagcgtctggtgagcaagagcgccgctatcgccatcgcgccgggtccgttcgtcatcgacattcgggacctcgacttcatgggatcatgtgcatacgctgtgttggcccaggagtcggtgcggtgtcgccggcgcggggtgaatatgcggttggtgagtaaccagccgatcgtggcccgcaccattgccgcgtgcggactgcggcgactaattccgctgtatgcaacggtcgagaccgcactggcgccgcctcccagcgcgcattgaccgacccattaaccgaccggtgccacccaacccgccatggtgtcgggttaaccgccgccgacaagattgaccacctcccgcgcacaaccccatgacagggtcacgccgtcacctccgtggccatagttgtggatgcacagcgctcgcccgatcggttcagcttccacccgcacggacggccgatcaggacgcagcccggtaatcgtctcaatcactgccgcctcggcaagccgtggttgtatgcggcgacaccgttgcaggatccgctcggttatctccggctctggggtggggtcccacctgccagggatactgatgccgccgcagactacacgctgcgggtgggcaaagtagcagatccattccgagccgccggtgcgctcgataaacagttgctctagacctggattggtgaggacgacgtgctggccgaaccgcggccagaccgtggcgtcgccggccagttcccgagcgcccagaccagcacagttgatcactatgggcgccgcctcagcggcctcggccagcgaccgtagcgggcgcgtttcgatttcacagccagtcgccgccaatcgctgggtcagacagtcgaggtactggggcatatcgatcatcggcaaggtggcatgaaacccagcacggaagcccccgggcacgtcggccgggtcagccggccgcacgtcggggatcagctccaacccgggcggcatcgcaccggtctcgatacgatcgccgacactcagcgccggcgtcatgcgcacgccggtggcgggatccttggccaagtcgcgaaacacgtgcaatgactgttcgatccacccgcgtaccttggcaacgggttccttcggccgcggcccccagaccgcacccgccaccgccgatgtcgtttgctgcggcaatgcggccgcccatacccgcaccggccaccccgcctcggccaggcatatggccgacgtcagtccgctgacgccggccccaatcacgatgacctgttgctcacctattgccacagcaggaccgtagccgaagccagcgtcagttagggctgaggcactcgccctccagtcggtccgagtaagccgttgaggatgccgagctgattttgtagttgggcccccgcttcaggtccaggaactccggcaggggcagcgccttcgctgcccgtgttctgccagggttggcagccgtgcgtcttgaacgccttgtcggtcggctcaatcgtcactacctgtggtttcttgctgagtgcgttatcgatgagcgcgccatcggggttacccatccgcttccaatagcaggtgccgtcgccgacgggtcccgcggagctgtacgtgccgggagcgatgtcaatccccaccgcataggtgccgtcgctatcaattgccgtcttcggtgtcggtgccggctccggatcggcgccggcgaggcccacggatccggcccagcctgcgaggatcaggccggcgacggcaaaggctgcagcaggagatggggctggcttcaagcgcatcacacaatagcctactggggcctaccggtatccggaactcactcggcctggaagcaatcactcgttctcccgccgccgatgggcttgttcgatccccatatgcgcctgcgagcgcacggacggcgcgccaccgacgcagtgtccggcaatgatgcggtaaatcgcggacggcgccaacgcttccaccgagtcacagccttgtccgccagcacaccgcccagaccgcatgtatcggaggatgtccggaagccgttggccacctccgtgtcgagcaaccaccgctgtcactgcattgctgtcactaaatcgttgtccggcaacacgtttagagcgctcgcgtcaggctgacctcctggtggctcgcatcccgagcaccggctgggtaccgcgaccttcgtcgaagtccgccgcccacggccagcgaccacgccggtcggcccacaccaactgcaaggccgtcaccttgtcgccaaagatggcgatcgcacaatacaaatgcgcgtccggatgtgtaacctggaccgtttcgacaagagggccggctgggagggtggtctgcataccgggagtcagcaagtcaccgaccagagccctgcgagcggcgatgttcaacaaccgctgcccacgtcgtggcgagaggccagtcaccaccagttcgggcaagccgcgccgggttagaccaaccgtgtaggcaaatggccgtcgctcgcactccacgtgctgtaccgcccagccatgcatgagcattatcccgtacacctcgtcgaggtactcctcggcggtggcttccgggtgatcgcacatccagcacatttcggcgccctttctcctcatccccgtctcgtcatccccgtctcgtcgtgcctgcgaccaccatgcacgcggggtctgacaaatcgcgccgggcaaacaccagcaccccgcgagccggtcagctcgcggggtgctgcggcgggttgtggttgatcggcgggcagggccgatcaacccgaatcagcgcacgtcgaacctgtcgaggttcatcaccttgtcccaggcagcgacgaagtcctgcacgaacttcggctgcgcgtcatcggcgccatagacctcgacaagcgcccgcaactccgagttggacccgaagaccaggtccacgcggctgccggtccacttcaccttgccactgccatccttgccctggtaggtcccgtcatctgctggcgagggctcccaggtgatacccatgtcgagcaggttcacgaagaagtcgttggtcagtgactcggaggcctcggtgaacacgcccagcggtaagcgcttgtagtttgcgccgaggacgcgcaggccacctaccagcaccgtcatctcaggggcactgagcgtaagcaggttcgccttgtcgagcagcatgtactcggccggcaacgggttgccctttccgaggtagtttcggaagccatctgccttgggctccagcacggcaaaggattccacgtcggtttgttcctgcgacgcatccgtgcggcccggggtgaagggcaccgtgatgttgtggccagccgcctttgctgctttctctatggcggcacagccaccgagcacgacgaggtcggcgaaggacactttgatgttccccggcgccgcggagttgaatgactcctggatctcttccagggtgcgaatgaccttgcgcagatccccgtcggggtcgttgacctcccacccgacttgtggctgcaggcggatgcgaccaccgttggcgccgccgcgcttgtcgctaccacggaacgacgacgccgccgcccatgcggtcgaaactagctgtgagacagtcaatcccgatgcccggatctggctcttaaggctggcaatctcggcttcgccgacgaggtcgtggctgaccgcagggaccggatcctgccacagcagggtctgcttggggaccagcggcccaaggtatctcgcaacgggacccatgtctcggtggatcagcttgtaccaggccttggcgaactcgtcggccaattcctcggggtgttccagccagcgacgcgtgatccgctcatagatcggatccacccgcagcgagaggtcagtggccagcatcgtcggggagcgccctggcccgccgaacgggtccgggatggtgccggcaccggcgccgtccttggcggtgtattgccaagcgccagcagggctcttcgtcagctcccactcgtagccgtacaggatctcgaggaaactgttgtcccatttcgtcggggtgttcgtccatacgacctcgatgccgctggtgatcgcgtccttaccggttccggtgccatacgagctcttccagcccaagcccatctgctccagcggagcagcctcgggttcggggccgaccagatcggccgggccggcgccatgggtcttaccgaaagtgtgaccgccgacgatcagcgccgctgtttcgacgtcgttcatggccatgcgccgaaacgtctcgcgaatgtcgaccgccgcggccatggggtccgggttgccgttcggcccctccgggttcacgtagatcagccccatctgcaccgcggccagcgggttctccagatcccgcttaccgctgtaacgctcatcgccgagccaggtggcttccttgccccaatagacctcatcgggctcccactggtcgacccggccgaagccgaacccgaacgtcttgaagcccatcgattccagcgcgcagttgccggcgaaaacaatcaggtccgcccatgagagcttcttgccgtacttcttcttgaccggccacagcagccggcgcgccttgtccaagctggcgttgtcgggccagctgttaagcggcgcgaaccgctgcatgccgcccccggcgccgccgcggccgtcgtggatgcggtaggtgccggcagcgtgccacgccatccggataaacagcggcccgtagtggccgtagtcggcgggccaccacggctgcgaggtggtcatcacttcctcgatgtcccgcgtcagggcgtcaacgtcgatggtcgcgacctccgcggcatagtcgaacgccgcacccatcgggtcagcgacggccgggttttggtgcagtaccttcagattgagccggttgggccaccagtcctggtttccgccgccctcgacggggtatttcatatgacccacgacgggacagccgttgctagcggctccggtggtggtttctgtaatgggtgggtgttgctcgggcacagcattccttccaggagttggtgttatcgggctgtgatcacggatgtgatcgcgaagtgtcggatatcgaacaatcaggacatagaccccagtagatgacctccgcctcgtccaacaggaagccgttatggtccgaggccgtcagacagggtgcctcgccaacagcacagtcgacatcggcgataaccccgcaagaccggcagacgatgtgatggtggttgtcgccgaccctggactcgtagcgcgcgacggagcccgagggttggatctttcgcaccaagcccgcggcggtcagggcatgcagcacgtcgtacacggcttgccgggatacgtcgggcagcgcaaaacgcacggcaccgaaaatcgtttccgtgtcggcgtgtggatgcgcattcactgcttccaggacggcgacgcgcggtcgggtcacgcgcaggtcggccgtccggagctgttcggcgtagtccggtatagaggacacactagacaatatgactcccttttctggaatcagtcaagactttggctagcgtgacaggcgtctgctaggacccgatcgccccggggccgctggatcgtgggatggcgggtggatcagccttcgtatgttccgatgagccgggcctgcatggtggcggcctgcgcgatcacccgcgccgcttgtgtcccagccagtcccgcgagtggaggcacggcaggaaggtggtagagggtaaaccggtagtggtgtgtcccggtgcccgccggcgggcaggggccggtgtatgcgggctgaccgctggagttcggcaggctgattccgccaccgggagtctcaccatcggcggtgctgccagcaccaggggcgatcccgatcacgatccaatggacgtaaggttcgcgaggtgcgtccggatcatcgacaacgagtgcgccgccaaacggcgccgaccaggtcaacggaggcgcgatattggctcctttgcaggtgtactgttccgggatcggcgcaccgtcggcgaatgccggactgctgattgtcagtacatcgccggtaggcgtttcgggcatactccgaccgagcgctgctgctttcggcgccagcggcgccgcctttcgactgtcaccgttgccaccgtaggcaactagcgccacggggagcgccagccccaagatggccagtgcgaaccggtgaaatgcgtgcgccactgtcgattccatattgatcattgtcgccaggcgcaattggagaagccagggtttcgaccacctcgccagggatgccgcggcgtcagccttcgaatgtgccgacgagccgggcctgtccgctggcggcctgtgctatcgcctgtgccgcttggactcccgtggctcccggtggcagctggagcgcgacaggaaggtggtagagggtaaaccggtagtggtgtgtcccggtgcccgccggcgggcatggaccgaagtatccttgccgaccaccagaattcggcacgctgtgcccaccagcaggagtctgaccatccgccgtgctgccagagccaggggcgattccggtcacgatccagtgcacgtacagtccgccgaccgcgtcggggtcatcgacgacgagtgccagttcggctgcgcccgcgggcgacgaccacgtcaacggtggcgccacgttggcccccttgcagctgaattgcaccgggatcggggcgccgtcggcgaacatgggactggcgatcgtcagtggctcggcggccggcgccggcgttgttgcgtcgacggtcgtcgctttcggcacgtatggcggtgtctctcgactgtcaccgcccccgcccccgcagccacccagcgccactacgagcgccagccccgcggtggctaatggggttcggtgaagtgtgctcgtcattggagattccatagcacattgttactaactgggattcgagagtacagctgttttgcggccgcgcttaccagacagccgggccccgggccacccatcgcctcacggtaccagcaccaccttgtcgacgttctcccgtgcggccagaatccgatgtgcttcaggagcttcggcgaacggcacgattgcatgaacgatcggcaggatcgttccgtcgttgagcgccttggtcagcggcgcgatccagggttcaagggtgcggcgatcgtcccacaaccgcagcatgttaagaccgatcacggttttcgactcctcgagttgtttcatcaggttaaagccgcgcagcattgacaacgcgtggggcgccaccctgcgcatcgatcgtttctcgccgtgctgcatattcgaaatcccgtagccaaccagccttccacccgggcgcagcagagtgtaggaccgccgcagcgaggtgccgccgagcgcgtcaagcacgacgtcatacgggcccaatccctgccaccagccgtcccggcggtagtcgatcgcgcggtccacaccgaactcggccagcttctgatgtttttggggtgatgcggtgccgtgcacttcggccttggctgctttcgcgaattggaccgccgcgatgccgactccaccggccgcggcgtgaatcagcacccgctcaccggcgcgcaacgatccgtagccgtgcagcgccgcccaggcggtcgcgtaattcaccgggaccgcggcaccctgttcgaagctcagcgcatcggggagcacaaccgagtcggtggccgcaacgttgacgatctcgcagtagccaccaaatcgtgtaccggccaggactcgttcgccgacccggttcgggtcgaccccatcaccgacagcctcgaccgtcccagcgacttcgtatccgaccaccgccggaagtttcggcgcgtctgggtacaggccgacgcgggcgagatggtcagcgaagttcacccctgctgcgcggacggcgacccgcagctggcccgggcccggtggcggcgggtccggtcgctgccgcacctgcaagaccgatgggtcgccatgtttggtgatgaccactgctcgcataatgttctccttgtcaggcttgacgggtcgcacccgcgaacacccctctgtgatagcacgagttatcaggaggttcggcggggcgttacctttgcggttgtgcacttcgactgggagcgcctgaccgacagcgtgcatcgctgccggctgccgttctgtgacgtcaccgttgggctggtccggggccgcaccggaatactgctcgtcgacaccgggaccaccctcggcgaagcaacagcaatcgcggccgacgtcaagcagatcgctggttgccaggtaacgcatgttgtgttgacacacaagcatttcgaccatgtgctgggttcctcggtgttcgaccaagcggaggtgttctgcgctcccgaggtcgtcgaatacctacggtcggctaccgaccggctccgcgaagatgccctgagctacggcgcggacacagctgaggttgaccgcgcgatcgcggccctgaaaccacctcagcacgggatctacgatgcagccgtcgatctcggggaccgcaccgtcaccatcactcaccccggcagcggccacaccacagcagatctcgtcgtggtggcgccggccaccggccatgcagacggcccaacggtggtcttcacgggtgatcttgtcgaggagtcagccgatcctgatatcgacgccgattccgacctggcggcctggccggcaacgcttgatcgggtacttgcgatcggcggccctgacgccagctacgtcccggggcacgggaaggtcgtcgatgcgcagtttgtccgtcgccagcgcgcctggttgcgaacacgtgcgagccgccagcctcgtgaaacgccagctactttgccgtgcaagcggtgacgagcgcatccgggtcggtaacgctgacccacaattcgcgcaccgtcatcgacttcttccacatctttgcctgttcgggcggatcgatcgtcagtgccaccaggcccttacgtgacccgttgaccagccagcggccgaatccaaagtgcaccccggctgcgtagacccttgcgttggtcgcctctgccttcgtgatcgacgtcaacgggatgtcggcggcaaatgcccatcccatcttgacgtgcaggctccccgccccaacccatagctcgctgttcttggggccgagcccgagcggcaccgcaagcgggagaaaccaacggtcaaagcgcaactgggtcggcaccaagatgaccctaccggtgctagtgcggctcagtaccatgtaggagttagtctcgaaccgccccagtggcgttgcggaatttgcgagccgtcatcggtcagtgatctaggtcgcccgtccggggatacactcggtccgtcaggtgaatcggggctgcagaggagcgcaaggccatggccatcgccgaaacggacaccgaggtccacacaccgttcgagcaggactttgagaaagacgtagccgccactcagcgatacttcgacagctcgcgctttgctgggatcattcggctctacaccgcccgccaagtcgtggaacagcgcggcacgatccccgtcgaccacatcgtggcgcgagaggcggcgggcgccttctacgagcgtctgcgcgaactctttgcagcccgcaagagcatcacgacgtttggcccctactcgccggggcaggcggtgagcatgaagcggatgggtatcgaggcgatctacctcggtggttgggctacctcagctaagggctccagcaccgaagatccggggcccgacctcgccagctacccgctgagccaggtgcctgacgatgccgcggtgctggtgcgcgccttgctcaccgcggaccgcaaccaacactatctacgcctgcagatgagcgagcgacagcgtgcggcgacaccggcttacgacttccgcccgtttatcatcgccgacgccggcaccggccacggcggcgatccgcacgtacgcaacctgatccgccgcttcgtcgaggtcggtgtgccgggctaccacatcgaggaccaacgacccggcaccaagaagtgcggccaccagggcggcaaggtcctggtgccgtccgacgaacagatcaagcggctcaacgccgcccgcttccagctcgacatcatgcgggtgcccggcatcatcgtcgcacgcaccgacgcggaggcggccaacctgatcgacagtcgcgccgacgagcgtgaccagccgttccttctcggcgcgaccaagctcgacgtaccgtcctacaagtcctgtttcctggcaatggtgcggcgttttacgaactgggcgtcaaggagctcaatggtcatcttctctatgcgcttggcgacagcgagtacgcggcggccggcggttggcttgagcgccaaggcattttcggcttggtctccgacgcggtcaacgcgtggcgggaggacggccagcagtcgatcgacggcattttcgaccaggtcgagtcgcggttcgtggcggcctgggaggacgacgcgggcctgatgacctacggagaggccgtggcggacgtgctcgaattcggtcagagcgagggcgaacccattggcatggctcccgaggagtggcgggcgttcgccgcgcgtgcatcgctgcatgccgcccgggcaaaggccaaggagctgggcgccgatccgccatgggactgcgagctggccaagaccccggagggctactaccagatccgcggcggcataccgtatgcgatcgccaaatcgctggccgcggcaccgtttgccgacattctttggatggagaccaagaccgccgatctcgccgacgctcgacagttcgccgaggcgatccatgccgagttccccgaccagatgctggcgtacaacctctcaccatcgttcaactgggacaccaccggcatgaccgacgaggagatgcggcgcttccccgaggagctcggcaaaatgggcttcgtcttcaacttcatcacctatggcgggcaccagatcgacggtgtcgcggccgaggaattcgccaccgcgctgcgccaggacggcatgctggcgctggctcggttgcagcgcaagatgcgcttggtcgaatctccctatcgcacaccgcaaacgctagtcggcgggccgcgcagtgacgccgcattggctgcctcctccggacgcacggcgaccacgaaggcaatgggcaagggctccacccagcaccagcacttggtgcaaactgaggtgccgcgcaagctgctagaggaatggctggccatgtggagcggtcactaccagctcaaagacaaactgcgcgtacagcttcggccgcagcgggccggctcggaggtgctcgagctcggcatccacggcgaaagcgatgacaagctcgccaacgtgatattccaaccgatccaagatcgccgcggccgcaccatcctgttggtacgcgaccagaacacgttcggtgcggaactacgccaaaagcggctgatgaccctgatccacctctggctcgtccaccgcttcaaggcgcaggcggtgcactacgtcacgcccaccgacgacaacctctaccagacctcgaagatgaagtcgcatggaatcttcaccgaggtcaaccaggaggtgggcgagatcatcgtcgccgaggtgaaccacccgcgcatcgccgaactgctgacgcccgatcgggtggcgctgcggaagttgatcacgaaggaggcgtagccagcgctgccaactgtcttgggggccaaccgggtgtgcgtcgaggtggcgcacatcgcgaaacgcgaaggatgctgtcagacggcgtctgcggtggcctgtcgaagatccagcgcaccggcgttcacctgcgtcggcccgcggtcgcgactaccatcgccgcccccgtttacggcccggcacccggtgagaagaagcccaggagcatttggccgatgttgttgacgcccgagttaaacgcagcggtgaggtgaccaacggtgctcgtgttgttgaagcccgagacggtgttgcctaggttcgccacgcccgacgccagctgcccgacgttgtagattcccgagactccgccttgcagcgcgttcggcacctggttccagaggcccgaaatgccgggcccgacgttgccgaagccggatgcgcttccatcgccactgttgaagaagcccgaagacggggtggtggtggagtttccgaagcccggggcgctcgtgatgttgatcgggatgttgatcggtcccaagccgccgttggcggtcaagttcaggggggatccgggaatggtgaagccggggatcgtaaccgggctcgtgcccccgctcaacggaacattcaacccaaacggattaatcgcgaaaccagggatcgtaaccgggctcgtgcccccgctcaacggaacattcaacccaaacggattaatcgcgaaaccagggatcgtgacagcgttggtagcaccgctcagcggaatattcaaaccgaacggattaacactgaatccctggatgccagactccagggtgccgccggccagcgtgacgcctaatacgaatgtgctaagcgggatggggccgatgtagcccgtgaagataccagcgacgttaaacggaagttcgttgagagtgatgttgaccggtatcctgatgttaatcgtaagggggatgcgggaaatagggacgccgggaacggtgatcggaccgacaccacccagcgcgttcaggctcaacggaataccaggaatagtaatatcaggcaccacaatcggaccgacaccacccagcgcgttcaggctcaacggaataccaggaatagtaatatccggcaccacaatcggaccgacaccacccagcgcgttcaggctcaacggaataccaggaatagtaatatccggcaccacaatcggaccgacaccacccagcgcgttcaggctcaacggaataccaggaatagtaatatccggcaccacaatcggaccgacaccacccagcgcgttcaggctcaacggaataccaggaatagtaatatccggcaccacaatcggaccgatgccaccattcacttcgacgctcagtgggatggcgggaatgctgagtgtgtctgagtagccaatcagaccctggtaatcgcccctccacagtatgccgttgctgtagctgcccgagatcagggcgccggtgttaaggtcgccaatgtttccccagccggtgttgaggtcgccgaggtttaggtaccccgtgttggcgttgcccgggttgaggtcgcccgtgttggtgtcgccggcgttgtagctgcctgtgttgtagcttcctgcgttgccgattccagtgttgacgttgccggtgttgaacaggcccgtgttggcgttgcccacgttacccaggccggtgttgtagttgccggagttgccgatgccgacgtttccgttgcctgagttgaagaagccgatgttgccgttgccggagttgaagaagccgatgttgccgctgccggagttcagcgccccgaatccgacctgattgtcgccggtgagcccgataccaatatttccagtgcccgtgttgccgaagccgatgttgccgttaccgatgttcgcgaagccgtagttgttgccgccgatgttcccaaagccaatgttgtgcagggcctccgtcaaccccggacccgtgtttgcaaacccaaggttgttgctgccgacgtttccaaaaccgaagttgttgcttccgatgtttccgaaaccgaaacttccgttgccgatgtttccgctaccgaagttgtagctaccgacgtttccgctacccacgttgtagtcgccgaggtttgcgttgcccaagttgagtgtgccgtcgttggcgaagccgaagttgaataacgtcccacctgcggcgttgcgcatgaagccggcgagttggctgtcggtgttaccgacgccggagtgaaaggccgatgtcgctaggcccagcgtgctggtgttgtagaggcctgagactgtgttgccgaagttcaagattcccgatgtcagtggcccgacgttaaggaatccggagttgccgagattcccagcaatgttccagaagccagatccgcccgaaccgacgttcccgaaacccgatgtgccgcccgtaccgctgttgaagaagcccgatgacggggtggtggtcgagtttccgaagcctggggtgcccgcgatttcgatcgggatgttgatcggcccgaggctgccggacacgtcgatgcccaacgggattgaggggatcgtgattggcggggtagtgagggggccgatggcgccgcccacatcaatacccaacgggattgccggaagtgagtagccatccgggaacaccgtaaacgggcctaaccctccgcccacatcaatacccaacgggattgccggaagtgagtagccatccgggaacaccgtaaacgggcctaaccctccgcccacatcaatacccaacgggattgccggaagtgagtagccatccgggaacaccgtaaacgggcctaaccctccacccacatcaatacccaacggaatagccggcaaactataaccacccgataagaaggtgatgggaccgatttgaccactcactgtcacgtaatctggagggaatccggggaaaaatggcggaatcgcgggaatctcaggagtgcctagctgtatcgatatgctacccgggcctatgctgccaacggtgggatttacgccgaataagccgatcgcaagcggagacgcggggatcgaaatcgatcccacgttaatgacctggaacgccgatagctctaggccaatagaatttagagtgatcggcgggatgttgatggggccaacgagtgccccggtactgttgatgcccagcccgatggcgggaacagtaataggcggaacattgatcggccccaccaacgctccggaactgttaatgcccaggccgatttcgggaatggtgatggacgggatggtgatggggccgacggagccgaggccgttgaggtctaggccagcagcgggaatggtcagtgtgccggagaagccgatcaagccctggtagtcgcctcgccagaagaagccgttgctgtagttgccagagttgaatccaccggtgttgacgttgccggtgtttcccacgccggtgttgaggttgccggggttgaagaagcctgtgttggagctgcccgtgttgaagtcgcccgtgttgaagctgcctagattgaagctgcccgtgttgtagttgcccgtgttgccgatgccagtgttggcgatgccggcgttgaagaagcccgtgttggcttggcccgtgttgccgatacccgtgttgtagctggtacctgagttcccgatgccgaagtttccggtgcccgtattgccgatgccgatgttgccggtgcctgagttgaacaagccgatattgccggtccccgagttccagccgccgaacccctgctggttgtcgccggtgaggccgaagccgatgtttccgttgcccgtgttgccgaagccgatgtttccgttgccggtgttgcccaagccaacgttgttgctgccgacatttccaaggccgaagttgttgccgccgggatttaggctgcccaagttcaaaatgccaaggttagcggcgcccatctgtccgaagcccgagtttgccaggcctaagctaagatttgccagcacacccttggaactggtgatcgccgcggtgacgacggccgccggagcggccgccaactgggcgggcaggtctgtcagattctgcggcggcgcagtgaacggcgtcagggccgacgccaccgccgatgccccggcatggtaggccgacatcaccgacacatcgatggcccacatctgttcgtatgcggcctcaatcgcagcgatcgccggagcattctgcccgaagaagtttgagaacaccaatgacaccaggtcggagcggttggccgccaccagcgccggttgcaccatcgccgcccggacagcctcgaactcggccacgagggccgcggcttgggttgccgaccgctgggcctgggccgctgccgcggcaagccatcctaggtacggcgctaccgcagcggccatcgccgccgatgacggtccgagccacgattcgccgaccaggcccgacgtcacggagttgaaagaggccgctgccgaggccaattccatcgccagttggtcccaggcgaccgcggccgccgacatgggttctgatcccgccccgccgaatatgagggccgagttgatctctggtggcaatgttgaaaaattcatggccccgactttccctgggtgcaccgaattcatggcggctcaccaacccgcggtcggcgagcgccgtgtcgctcgacgctactcggcgatcttcgcggccgtatgcatatcacccgaatagggccatgattcatagatctcgtcaaactgatttacggcgggcgctttttagccgctttaggaatcgacgccaaacccaacgaacgagcctcagccaaggccgaaatcgattaattccccgatgatttcatcgttgtggaggtcgtcgcaggcgtcgttgatctgatcgtggcgattacggctggtgatcctctccgcggggcggggtccgcacggattatggcgtggtgctctggaagaacaggcccgacaggttgttgccgatgttggccaaaccggagaccaagctggtcacggcaaacggcagggtgccggtgttggcgaagcccgatatgccgctgccaaggttggagaagccggagataagaccaccgtagttctggtagcccgagccggctagcagcccaacaggacttgtgttgaaccaacccgacagtcccgagccgctgttgccgaagcccgagttcccaccgattccggcgttgaaaaagcccaacgagggcgttgcgctcgagttgaagtatcccggccccgctgggattgcgaatccgcccatggtggtgctcggcaggtggatgctggcgatggtgagtgcgggtgtggtgaaggccgccaagcccaccggctggatggtgaactctggcgtggtgatctccgggatattgacctgggggagggtgaaaccgctaagtccgatcgggtcgatggcgaacggtggagtcgttatctcgggcgtcatgatctgaggaagcgtgaaaccacccagcgctatcggatcgatcgtgaacgccggggtggtaatcgccgggatgctgagctgcggcagcgtaaacccacccagcgtgatcgggtcgatggtcaactccggggtcgtgaactgttgagtagtgatatccggcaggctcaatgcaccgacaccaatcggactgatcgtcaacgccggagtggtgaattcttgggtgctgatctctggcagggtgaacccgtcgaccgagatccccccgagggaccacggttggatgacgacgttggggagggtgaagggggtgacgttgattgcgccgatcgagaagccgacgccgttgatttgacctccacccacggtaatggtcccagtattaataaaggcaggaggtgtattagcgaagccgccaatctgcgggaataccccgggcatattggtttgcaaggcagtgatgttgttcggaatgaacaccaccaaattagttatcgtaatgccgttaaggctaaaggtgggaagattgatgacaccagaatttgcttgcgtggctatgccgggagtgctaaagccgcctatacttatttggggtgtacttattaacggggtgtgtatcgtgggtagcgtaaatccgccgacagtggtgccagccggaatcgtgatcggcggaaccgtcaccgacggaatactcagcgtcggcagattgaacgcacctagcgctgtgccagccggaatcgtgatcggcggaaccgtcaccgacggaatactcaactgaggcaagttaaacgcacctaccgtgatgttggctggtgtcgttgtagctggaatcgtcaacgacggcaccgtcaaccccggcaaatcaaacgcacccaccgtgatgttagctggcgtcatcgccgctggaatcgtcaacgacggcaccgtcaaccccggcaaatcaaacgcacccacggtaacgttggccggcgtcgtcaccgccggaatcgtcaacgacggcaaggttatcgcgggcaggctgaacgcgggaaccgagattccgggtatttccagagacggaagcgtcaaatcagggctggtgatggcgaactgcaggctgccttggcccacaccacggtaaaagacaccattgttcatgtcgcccgtgttgaacaagccgttattcatgtcgcctatgttgaaggcgccggtgttgatgcttcctgtgttgaaccagccggtgttggcgccgcccgtgttgaaggtacccgtgttcgacgggcccgggttgaaggcaccgaagttgtagtggccgacgttgaagctgccggtgttcgcgttcccaacgtcgaacatgcccgtattgaaagagcccgcattcaggaatccggtgttgccgtgtccggggttgaacaggccagtgctgaagttaccggagttcccgatgccaaagttgccattgccggagttgaagaaaccgatattggcgctacccgcgttgaataatccgacgttaccgttgccggaattgagtccgccaatgccgatttggttgtttccagtcaggccgttgccgatattgttgttgccggtgttcgcaattccgaagttgccgatgcctgcattggcgaatcccgtgttcaaattgcccaggtttgcaagtccgaagttgttggcgcccgcgtttcctatgccgatgttgttgccacctaggttggccgagccgatattgaagctaccgaagttgccggaccccagattgttgttgccaaggttggcgttgccgatgttgccgagcccattgttggcattgccgaggttgccaccaccgacgttggccaagccgaggctagcggcgatcgcccggccggcaaaagtcggcatgcccacggccgtggtgagcgcggtcaccacggccgcgggcccggccgccagacccgccggaagccgcagcgggagggcgaatgccggtagcgccacagcgaccgccgacgccccggaatggtaggccgccatcgccgatacatccagagcccacatctcctcgtatgcggcttcggcggccgcgatcgcgggagcgttttgaccaaaaaggttcgatatcaccagcgatatgaggccggaacggttggcggccaccagcgccggttgtaccatcgccagccgcacagcctcgaactcggccaccatcacctgggcctgggtggccgcctgctcggcctgggtcgccgccgcggccagccaccccgcatacggggctgccgccgctgccatcgccaccgatgaccgaccctgccacgacccgccgaccagcccggctgtcaccgagccgaaagagacagcagccgaggctaattcggttgccagcccgtcccaggccgacgccgccgccagcatcggtccggagcccgccccggcgaagatcaaggccgagttgatctccggcggcaacactgagtaatgcatcgctccccaccttccggggtgagcctggtgctgatgaaaggtcacacgcccgtcgtcgctgactcgttcgtagcgcatgagagtacgcggagatcttgaattgtgtatccgagcaaatgaaaccgttatctatttgttatagacatatcgggcacggatgcaaagttcttttacacgctatgcgtaatcacgatccgtgcccgtctgatgtaaaccaccgacgtaggcgcactgatataaatgcatttattaccaaggtgattgggtgaaataattaccccggaaaactgtgctcaataggaacgattattagtttgaatcactgccataatccaccctatgtgcaacccggatgaattccgatcgcgtgcttattcctgccaaacattcgggctttagccctggcccaccacgcgggcaccaatccgacgctgcccctacagcgaaatcaccggcgcaccgcctcccgctcggccgccttcaccagttgacccgcgaagaacctgaccgcgccacccagcgccgcccgcatcaccggccccgtcccacgaaccttttcggtaaacgagccactccagcggagatcggtaccgcccgacgcatttggtgtaaggaccacctcgccgaagtagtcctggacgggtgtcctcgcgccaaccagcttgtagacgtggcgacggtcctgctcatactcgacggtctcttcctgcacgaacaccggccacatgcctagtttgcggatggccccgatgccgccgggcgcgggatcaccgcgtcgcgcccaactcgattgagcaacgatgggcttggcccaggtcgcccagttgccaccgtctgtcacgagccgaaacaaggttgcagccggcgcgctgctggtcttggtgacctcgaacgaaaatttccgacccgacatgcgcgactcccgaaacgacaactgaagcggcccgatatggtgctgccgcgtaccctaccgcgcagccgtccgtgccggccgtagtggaccagccaaggtgttcccgcgctggccgcagcaggcgcataatcacgaggtgtcccgcgcagataccgtctcagtgccccgtgcgcccacccaggctgaggtcgccgcagtgctgcgcatcatgacgccgctgcgcaaggtgattaaaccaaaggtctatgggatcgaaaatgtgccgaccgaacgcgcattgctggttggcaaccacaacacgcttggcttggtcgacgcgccattgctggccgccgagctctgggagcgggggagaatcgtccggtcccttggcgaccacgcccatttcaagattccggggtggcgcgacgcgctgacacgaacaggggtcgtcgaaggcaccagagagatcacctcggagttgatgcgacgcggcgagctcgtcatggtctttcccggcggcgcccgtgaggtcaacaagcgcaagaacgagcgctacaagctggtgtggaaaaatcggctggggttcgcgcgcttggcaattcagcacggctatccgattgtgccgttcgcttcggtgggtgctgaacacggcatcgacatcgtgctcgacaacgaatccccactgctggcaccggtccagttcctcgccgagaagctgctcggcaccaaagacggtccggcgctggtccgtggtgtcggactgacaccggtaccgcgccccgaacggcagtattactggttcggcgagccaatcgacaccacagagtttatggggcagcaagccgacgataacgccgcacgcagggtgcgcgagcgtgccgccgccgctatcgaacacggcatcgagctgatgctggccgagcgcgcagccgatccaaatcgatccctggtcggacggctcttgcgctcggacgcctaaggcgcccctgaggcgttcccggggcctgattcagaagtcagaagaccgagtcgacttgatcggggattggggtgccgtcgttgcgcaataccggttgtttcgatccgtcggggttgatgaatgcctccccgcatacgtaaggagcgtgctggggcagcgggtcgataaacatcgggttgatcgcccacttaccgcccctggtgaacaggccgtcgtaggcccggcacatgaggtcgtcctggttgcggttgatcacgagtgacaccacggtggcgtcgccgacgaaggtggcgtcgctgttcgagtcgccggcggcgaggacttgacgacgatccgccgcgagctgattgaaggcttgcgggccagtcaccccgaagatgacctgattggcccaacaccgtttgccatcaaggtaggtcatgactgaatcgtcgccgtcgcggacgcctccgcaaccgacgaggtgagcggtgagtttcccggactggtcggcgacgctgcggactccgacgacatgctgatcgtctagacctacctcgcccgcccacaccttgacgatcggttcgggtgacgctgacaccacccaggtgtcgataccgtgtgcctgcagagtaccgatgaggtctttcatttgtggatagacgcggatgtaaccatcgacctgctgtgttccgacctgctgggtggcgccgacatcggcggcaaggttctgtttcttggcctggtctgcgaatccggcgagctcctcagcggtgtagcccgccgacagtgcgttgctccacgcgtacggacccgccaaccggcgcacgttgttacccacgaaagccggctgtcccgtggtggtttcgccgtcgagaagggaaaggatctcgttcgcgcacaacgcattgctgccggtcggcagcggcttgccggcaggtacaaccttgccgcatgccacgctcagcgcgttcgccgccgcgtcggtcaggtatcggctggcggcatgccaatcctggttggctggctgcagcaccaggctgtgctgcagcatgtagtagttcgtggcgtagccgatgtcgttcttgacgacggtgttgtcccagtcaaagatggcgaccttgcgcgcagaaccgtccgcggtgccggtgcacctgctgttggcatcgatcgccgactgcaggaattcacgaactccgtggtgccacttcagaaacgcgtcgagctgacgacagccggacgctggggtcgggggttggtgggccgagcagccgatgacgccaccgagcacggttgccattgccaacagcgacggtatgagtcgcaccatgtaagcccttcgtcagcccttggtcgtgccagcatgcgccggatggaagggggatgggaactgaatggttgcctgctgaactgaacgctgagcaaattcgatgccgacgaaacattatgggtttgtttctcgacggcaacccgtgcgcgattcgacagtcaccgcgatgctgccgacgccggcccgcgctcccgggcgatccgcgtgagcagcgtaatctcgtgcgcacggatttgcggcccggactagcgcgaaagatactgttgaacagatggattcgactgtaacggcctcgatccgacgcatgctgggactgctcgccgccacattgctgctcggcggctgcaccggccagcacacgacacgcacagcggcgagcaccacatacacgccccacatcaaggccagcagtcaggacgtactggacggcgccatcaatgccgacgagccaggttgttcggccgcggtaggagtcgaggggaaagttatctggtcaggcgttcgcggcattgcggatctggcatccggcgccaagatcaccacggacaccgtgttcgacatcgcgtcggtgtccaagcagttcaccgccaccgcgatcctgctgctcgtcgaagccggaaagctaacactcgacgacccgatatcccaatacgtacccgagctacccgactgggcccaaaccgtcaccgtcgagcagctcatgcatcaaaccagcggcatccctgattacgtcgcattgctggcagccagggggtatcaggtcagcgaccgcaccatcgaggccgaagcccggcaggcgttagcggccgcccccgagctgcaattcaagcctggcaccaggttcgattactccaactccaactacttgctgctcggcgagattgtccaccgcgcatcgggacaaccgctgcctgagttcctcagcgccgagatctttcaaccgcttggtctggccatggtggtggatccggtcgggaaggttcccaacaaagccgtgtcatatgagaagggcactggtggaaaccggtccgagtaccgggtgggcaatccggcctgggagcagatcggcgacggtggcatccagaccacgcctagccaactggcccggtgggcggacaactaccggacaggaagcgtcggcggcctgaaactgctcgaagcacaacttgccggtgcggtggaaaccgaacccggtggcggcgaccgctacggcgccggaatcgtgtcgcgcgccgacggaacactcgaccacgcgggcgcctgggccggattcgtcacggcattccacatcagcagtgaccgacggacttcggtggccatcagctgcaacaccgacaagccggacccggtggccatggccgatgcgctggggcgcctttggatgtagcggggctaccgcggttggccgccggtacccaggctgcaatcattcacggtatggcgcaaccaccgtcactcctcacaactgacaatggcctacccttcggcgtgcaaggtgcctgcgactcccgtttcaccggagtcatccgtgcctttgctgggctgtaccccggccgcaagttcgggggtggggcactgtcggtttatatcgacggtcgccaggtcgtcgatgtctggacggggtggtccgatcggcagggcaaagtaccctggacggccgataccggggcaatggtgttctccgcgaccaaagggttggccgcaacggtgattcaccgtttggtcgatcgcggccttttgtcctacgacgcgccggtcgcggagtactggcccgagttcggagctaacggcaagtctgaggtcaccgtcagcgatgtgttgcgacatcggtccggactggcgcacctcaagggggtggacaaggacgaggtcatggaccacctcctgatggagcagaagttggcggctgcgccgctagaccgccagcacgggaagttggcttaccatgcggtgacttacggatggctgctgtccggcttggctcgtgcagtgaccggcaaaggcatgcgtgaactgttccgcgaagaactcgctcgcccgctgaacaccgatggtattcatctcggccggccaccggccgactcgcctaccaaggcggcacagacacttctgccccaagccaaggtccccaccccactgctcgatttcatcgcaccaaaggttgcggggctgtcgttctccgggctgctcggcgccgtctacttcccgggcatcctgtcgttgctgcaagacgatatgccgttcctcgacggtgaggttccggcggtcaacggcgttgtgaccgcgcgcgccctggccaagacgtatggggcgttggccaatgacggtgtgatcgacggcacccgactgctgtcgtcgcaggcggtacgtggattgacggggaagtccgagctatggccggaccttaatctcggtcttccttttacctaccaccagggttaccaatcgtctccggtgcctgggctgctggaggggtacggccacatcgggctcggtggcacgatcggatgggccgacccggagaccggcagcgcattcggatatgtgcataaccgcttgctgacgctactgttgttcgatattggctcgttcgcagggctggctgcgctgctgaacagcgccgtcgtggcagcacgtcgcgatgaccccctggaagtgccgcatttcggtgcgccctatagcgaaccgcgtcatgagcaggcggcctcgggtgcataactgctcccgttatgccgcgagcgcgagcccgacgggctagaactcgtaaacgagtagccagacgagagcgacggccgccaagaacagaccaaccaggatagccgcgcgggtaaccagtacctggcgatggaaccactctcgcagctgggtgaatcgccagtcggtccaggcgtaggcgcgcacagcccactgcgcctcgaccgcgagcagtcgaaacgcgaccagcagggccgggatgccgagttcggggagcagcacgatcatcggcagggatacgacgaatagcccgccaccgaccacagcgagtgtcgcgcgaatcagtagcggcctggcccgtacccgctgtcggtatgcgagcactcgggcgagcgcggcgtcgcgggtggaagtcgggttgatgacgtcggccgggtccatgactgctcctagtgtgcctgcctcgacgcctagcggacggctgtgtcgggggtggtttggttcggactctagtggagcccggttgcgcactcgggtccgaccaatgcggggccgcgcctcatacgcacgataagcgtgggtgtatagactgcggttatgaatgacggctcccggcaggaactcagggttcgtagcggcctactacaaatcgaggactgcctggatgctgacggcggcatcgcattgccggcaggcaccacgctgatctcgctcatcgagcgcaacatcaagtatgtcggcgacctcgtggcgtatcgctacctggaccacgcccgttcggccgccggatgcgccctggaagtgacctggacgcaattcggtatgcgattagcggccataggtgcacacgtgcaacggttcgcaggccccggcgaccgcgttgcgatcctcgcaccacagggcatcgactatgtttgcgggttctacgctgcaatcaaggcaggcaccgtcgcggtgccgttgttcgcacccgaactgccgggtcacgccgagcgtcttgatacggcacttcgcgattcggagccagcggtcatactcacgacggcggcggcgaaaaacgccgttgaaggttttctgaacaacgttccgcgcctgcgaaagccgacagtcctcgtcatcgatcaaatacccgaccgcgagggggagctgttcgtcccggtcgagatggacatcgacgccgtatcccacctgcagtacacctcgggctcgacgcgacccccggtcggtgtcgagatcacccaccgcgcggtcggcaccaacctggtgcaaatgatcctgtcgatcgacctgctcaaccgaaacacccacggcgtcagttggttaccgctgtaccacgacatgggcctatccatgatcggctttccggcggtctatggcggacactccaccctgatgtcgcccacggcgtttgtccgcaggccactgcgatggatccaggcgttgtccgaggggtcgcggaccggacgcgtggtcaccgcggcgccaaacttcgcctacgagtgggccgcacagcgtggactacccgcgcaaggcgacgacgtcgacctcagcaatgtcgtgctgatcatcggttccgaaccagtcagcatcgatgcggtgaccacgttcaacaaagcgttcgcgccctatggtttaccgcgtacagcgttcaaaccctcgtacggcatagccgaggcgaccctgctcgtcgcgaccatcgaccatgccgctgagccgacggttgtttatcttgacccagagcagttgggcgccggacacgcgacgcgcgtcgcgccggatgcgcccaacgccgtcgtgcacgtgtcgtgtggccatgtggcccgcagcctgtgggccgtgatcgtcgacccggataccggccccgaggcgggcgccgaactgcccgacggtgagatcggtgaggtttggttacaaggcgacaacgttgctcgggggtattggggacggccggaagaaacgcggatgacgttcggtgcccgcttgcaatcaccgctcgccgaaggcagccacgccgacgggtccgcgatcgacgacacctggctgcgcaccggagacctcggcgtgtacctcgacggtgagctctacatcaccggtcgaatcgcggatctgctgaccatcgacggccgcaaccactatccgcaggacatcgaggccacggccgccgaggcctcgccgatggtgcggcgcggatacataaccgctttcacggtgccggccagcgacggggacgaccgcaatcagcgactggtgatcatcgccgaacgtgcggcaggcaccagtcgcagcgacccgcggccggcgctcgacgcgattcgcgcagcggtttgcaaccgccacgggttatccgttgcggacctgagtttcctgccggccggcgccattccacgcaccaccagcgggaagctggctcgccaggcctgccgcgcccaatacctcagcggtcgcctgggcgtgcattagctacgatctacggctcccaaatcagcagatcctccatgccgttgttcatcgcgacgatggttggcgatgggccggtgacatcgaagtagattttgccggtcgattgttcgccttgggggatagtggctccgctaatggtgtcggggcccgcggcttgccacagcacccggtagttgatgccgtcggcggtgcgggcattgaactgcgagaccgcgggcgtgacgctgccgcgaatcgcattgaccgtggcagtggcctcccagacctggccggccaccggatagccggggatgactgccgtgctggatttgagatcactgaccttccagccgagcacgacttggccaacggtgtcggtcatcgttagctcactgccaagttttccggtgatgggataggcagccaacgcgaccggtgccgcaaaggtcgcgatggccgccatggccacgaccgctactgccgtcttgatcattgtggtgagcttcattggtccctacctccactacttgttggggcgattacctggttcgaacctcgccgacgtcattaccttaagccgcaaatgacccgctgctaactccagattcgataggaaccgtggggcagacgatgccgttcacatccgtagccggcgcaccgacgacgggcgtggccatgaatgcttgatggccgagtcgtaggcgaccagcgcaagggagccaaaccgcatgtcaggatggtgtggtgaccgccatacccggcccgtcgggcgccgaacccggtgagagccgcgcgctcgcgggttacccggtgacgccgccggcgctgccccgcccggtgatcttcgaccagcgctggactgacctgaccttcatccactggccggtgctgccggagagcgtggcaggcagctacccgcccgggactcgccccgatgtcttcgccgatgggatgacttacgtgggtctggtcccgtttcgcatgagcagcaccaaactcggcaccgcactgccgatcccgtatgtcggcaccttcccggagaccaatgtccggttgtactccattgataacgccggccggcacggggtgcttttccggtcgctggaaacagctcgactgactgtcgtaccgctcacgcggataggactcggcatcccgtacgcctggtcgaggatgcggatgatgcgctctggtaagcacattacgtatcacagtgtccgccgctggccacggcgcggactgcgcagcctattgacgatcaccatcggtgacctggttgagccgacgccgctggaagtctggcttaccgcacggtggggtgcgcatacccgcaaggctggccggacttggtgggtgccgaacgagcataagccgtggccgttgcgggccgcggagatcgccgagttgaacgacgagttgatcgacgcaagtggcgtgcaacccactggcgatcggttgcgcgccctgttttcaccgggtgtgcatgcccgattcggccgtccgtgtgtcgttcagtgacgtttaggggcaggtgtatccaccatcaatcacgatgtcggaaccggtcatatagctggaagcctcgctagccagatacaggtagaggccagcgagttcttcgggccggcccaaccggcccaacggaatcttgggctcccatagcggctggtattccgtgtacggttcgacgagctcggtcaggatatagcccggactgacactgttcacccggattttatgcggcgccaactccacggccatggctttggttagatgaatgaccgccgccttggaggcgcagtagtgggaaacctgctgcgggacgttgatgatgtggcctgacatggaagcagtgttgatgatgaccccgccttggccttgtttgaccatcgccttggcagcggcctgcgcggtaaggaagacgcctgtcacattggtgttttggaggcgctggaactcttccagcggcatgtccagcatcggagtgaccgtgatgatgccggcgttgcagaccgcgatgtcgatcccacccagctccgcggtcacctgatccaacatgctggtcacctgctggtgctggctcacatcgcagcagacgggcacgaccttgccacctgatgtgccaatctcatccgccaacttctctaaggcatccaaatgccgtgcggcgatcgccacttgagccccggcttcgacgtatgccagggcaactctcttgccgatgccggtggatgccccggttatcagcgccctcttgccgtgcaagtcgaacaggtccaacacgctcattcgtgatcccctttcgcgcgacgcagggccgatacctgatggaatcacatgccgaaatgcgttcgatgaactgccgcaatggcttccagtggtccgctcacttcgacccgcgctacggctcggcgtccaaagacgtacagcagcaactcgccgggcggtccggtcaggcgagccgtcggctcgcctgaccggaccctcacccgcttaccggttccaacccactcgatctcaagcccgcaaccgtgcagccgccgactcaggaagtggctgccgcgccgaacatttcgccatagggcagcatccatttcgggcgtgaggcttcggggccctcgtccgctggcgcggcgaacgtcctcgtgatggacaaagaattcgttgaggttcgccaaggtacgaacccatccgatgcggaagaaccccatcggtggaccggaccgaatccgagcgacgagccacgtgaagtctttactctgagccaatctcgctctacggcgttcggcaaaccgctggaagggacccggtagaacgatgcaaaggccagcaacgagatcgcgttcacgcagcacgatgtgagcggccaggtcgtgagcagtccagccctcgatcagtgtagcaaccgcaggaccgagctcctcaaggagatcacagagctccaagcgttcttgcgcgtccaacgggacatcagccacgccgcgggagtctacgggcgacgtgcctgcgcgccaacgggctgccgcttgcgccgtcgcgactgcacagcagccagcgcccgctcccaggcgagcagcgttgcggccgtcagattggccggtttggcgctgtccttggacagcagcgcggtcgcggcggctttggtggtcggcgacgccttcgacatgtgaccggagtcgaacggcggctgcgggtcgtactcgatcgccagctgaatcgccttggcccgggcctccccgcccagctgtccggccagccagagggcgagatcgagcccggcggacacgcccgcgctcgtgacaatgttgtcctggtgcacaatccgctcgtcggcgaccgggatagcgccgaatgccttgagcgcgggaagcgtcagccaatgcgaggtcgcgcgccggccccggagccacacgaaccgcacctgggcgtgcggcaggtttcgcagcacctcgtacgggccgaccacgtccagcgcggtaacgccggggtaggccacgaatgcgatttgcgtcatcggtgttctccctagtgtcaggcgaaggctttgcggtattggtcgggtgatatcccgacgcggcgaatgaagctgcggcgcatggtttccgcggtcccgaagccgcatcgggcggcaattgccaccacggtgtcgtgggtctcctccaactggcggcgcgcagcctcggtgcggatgcgttcgacgtaccggccgggcgcctcgccgacctcgtcgctgaacacccgagtgaaatgacgcgggctcatggccgcacgttgagccagttcgccgatgcggtgcgcgcccccggctcggcctcgatggcctcctgcacccggcggatcgaggtccgtttggcgcgtggcatccacaccggagccgcgaactgggtctgcccaccgggtcggcgcagatacaggacgagccagcgggcaaccgtctgggcaatctcggtgccgtggtcgtcttcgaccagtgccagcgcgaggtcgatgccggcggtgactccagccgcggtccacaccttctgcgaactgcgcatgaagatcgggtcggcatcgacccgaacggccggaaattcgcgggcgaaatgttcggcaaaggcccagtgcgtcgtcgctcggtgtccgtcccaacaaccccgcttcggccgcaagaaacgcgcccgtgcacacggtgacgacgcggcgggcggtgccggagacggctttgacccagtcgatgagggccggttcggaccgtgcggcatcgactccggcgccaccgggcaggatcacggtgtcgacggggtcgccggggaatcccacgataaccactcttcgcgccatgaatgccagtgttggccaggcgctggcctggcgtccacgccacacaccgcacagattaggacacgccggcggcgcagccctgcccgaaagaccgtgcaccggtcttggcagactgtgcccatggcacagataaccctgcgaggaaacgcgatcaataccgtcggtgagctacctgctgtcggatccccggccccggccttcaccctgaccgggggcgatctgggggtgatcagcagcgaccagttccggggtaagtccgtgttgctgaacatctttccatccgtggacacaccggtgtgcgcgacgagtgtgcgaaccttcgacgagcgtgcggcggcaagtggcgctaccgtgctgtgtgtctcgaaggatctgccgttcgcccagaagcgcttctgcggcgccgagggcaccgaaaacgtcatgcccgcgtcggcattccgggacagcttcggcgaggattacggcgtgaccatcgccgacgggccgatggccgggctgctcgcccgcgcaatcgtggtgatcggcgcggacggcaacgtcgcctacacggaattggtgccggaaatcgcgcaagaacccaactacgaagcggcgctggccgcgctgggcgcctaggctttcacaagccccgcgcgttcggcgagcagcgcacgatttcgagcgctgctcccgaaaagcgcctcggtggtcttggcccggcggtaatacaggtgcaggtcgtgctcccacgtgaaggcgatggcaccgtggatctgaagagcggagccggcgcataacacaaaggtttccgcggtctgcgccttcgccagcggcgcgaccgtctggagttcgtcaccgttggccgcgctcatcgcggcgaacatcaccgtcgcccgggtggcgtcgatctcgatcatcatgtcggcgcaggcgtgcttgaccgcctggaaggaaccgatcggtcgatcgaattgcgttcgccgcccggcgtattgcaccgccaggtcgaggcaggcctcggcgccgcccagcatctcggcggccaacagcacccgggccacgtcgagcacccgctccatatcgtcgggcgtcccggcggtcagcggctcggcgggggaccccgccagccggagcgtggcgaccggacgggtgatgtcaaacgagggcaacggtgtgacggtcaccccgggggcgtcggcggccacgacgtgcagaacgatcgacccgtcggccaccgcgggcaccacgaacaggtctgcgacgtgaccgtgcagcaccggggtgcactcgccggtgagtgcgggccgaccgtcgcgccgaacggcccgaacggtggtagccgacgcgacgtcgtggccactgacggcgatcgttccgatccgcgcgccggtaagcagaccggcgagcaggcgcttgcgctgctcgtcgtcgcccatgcgcagaatcgcttcgatcgcaaacaccgtggccgcaaagggaattggggtgagcgcccggccgagttcggcaaacgcgatcgcggtctcgactaaggtggcacccaatccgccgtgctccggcgggacgtgcagcgcgggtaattcgagctcggtgcaaagccgttgccacagcctgcggtcggatccgtccgcggcagccatctcccgcacgggcgcgccccggccaaggaagccgcgcagcgaggcgcggaaatcgtcttgttcggtgctgtatcggaagtccacgtcagcagagcacttcgggccgcggctccttggggaggccgagcagccgctcgccgatcacgttgcgctggatctgcgagctgccggcatagatcgtcgcggcccgtgcgtagagcagctcatccatccagcaggccggggagtttggcgtacccgcctccgggaccagccgcgcaccgccgttgccgggcccccgcgggcccagcgcctcgagccccaggatttcgacggcgagatcggtgtaccggcggaaatattcgctccagatgaccttcgtgatcgcggcttccgcgccgggcggccgtccggtcagggccagggtgaggtcacggtagccccgataccgcatgatctgaacccgggcatagcaccacgccaagccgtctcgtacccgtggatcggtgtgtaatccgcggtcacgggccagctcgcacagccgctgcaggtcccgctcaaaatcgatggcggcggtggcgatgtgcgatccgcgttcgaagccgagcagcgtcatggcggtcgaccagccgtcgccgacccggccgacgacattgccggcgctggtgcgggcatcggtcaggaagacctcgctgaacgaggagtgcccggccgcgttgacgatcggccggaccacgacgccgggctggtccatgggcaccagcagaaacgacaggccccggtgtttcgcagcgctgggatcggtccgcgccagcaggaagatccagtttgcggtggtgccggccgacgtccagattttgtggccgttgatcacccattcgtcaccgtcgagcacccccctggtgcgcaccgaggccaggtcggagccggcctccggctcggagaagccctggcaccaccgatgctcgccgctgaggatgcgcggcaggaaatgccgcttctgcgcctcggaacccagggcgatcagggtgttgcccagcaggtcgattccgagcaggtcgttttccgcgcgttcgggcgcgccggcgcgggcgaattcctcggcgagcaccacttgttccatcggggacaggccaccacccccgtattccgtcggccaggacaccgcgaccaggccagcgccggccagggcccgccgccagtgccgggcgaactcttcccgctcgtggggcggcagcgccccgggtccgggccacccgggcggcaggtgctcggccacaaactcccggatccggtcgcggaacgcttccgcttcgggtgggtagctgacgtccactgcgcgccccggcctcagggccgctgcttgatcgcgggccggatctgcggtgcggcgcgccagtcctccaggccgtactcgaccgttccgtaggacagcttgccgccggtgacttcgccccagtgcgcgtgattgagctggtggatcttgaagcaaccgtccagcgcggcggaaaaccccatggcatcgacggtttggttcaccgattccttgatcagcagtgccgccatcgtcggcaccttcgcgatccgacgcgcgaattcgattgtgctggtcgcgagttcgtcagcgggaaacaccttgctgaccatccccagcgcgtgggcctcgtcggcgcctatgcagtcgccggtgagcagcagttccttggtcttgcgcggcccgaactcccacggatgtccgaagtactcgaccccgcacatgcccagccgggtgccgaccacatcggcgaacacggtgtcctcgctggcgacgatcagatcgcagcaccaggccagcatcaaccccgccgacagcacggccccgtgcacctgggcgatggtgatcttgcgcaggttgcgccaccgcttggtgttttcgaagtagtagtgccactcctggcggttgcgtgactcgaccccgccgaaggtcgccccgttgcaccggtagctggggtgctggtccggcccgggcgagcgttcccggatatcgtcagcggatccgaggtcgtgaccggcggagaaggcggggccggcggcccgcaggatcaccacccggacggtgtcgtccgcctcggcaagttcgaaggcggcgcccagctcgaccagcatgccgcgggtctgggcgttgcgttgtttcgggcggtccagggtgatcgcggcgatgcgcccatcgtcgatggtttcgtagcggatgtattcgaactcccggggccgtcgggagcgttccccgtccgaccggcgatcgaccggaccgaccctgccgacgaacatgtccgctccttactggacgtgaacggctgacctgtgcgaggttacccgtcccttagccaacatgtccatagccaatacgcacatgagagtgatcgatatagacaaattcccatgcaaagaagcacttgtgtacaacgaagtatcttggtagtactgtgatatacgcaaagggcgccaccgcagcgcgccgggcatccgaccggtacaaccaggaagggttgacgatggagatcggaatattcctcatgccggcccatccaccggagcgcaccctctacgacgccacccggtgggatctggacgtcatcgagctggccgatcaactcggctacgtggaggcctgggtcggcgaacacttcaccgtgccgtgggagccgatctgcgcccccgatctgctgttggcgcaggcgctgctgcgcacccaacagatcaagctcgccccgggtgcgcacttgttgccctaccatcatccggtcgagttggcccaccgggtggcctatttcgaccacctcgcccagggtcggttcatgctcggcgtgggcgccagcggcatcccgggtgactgggcgctgtatgacgtggacggcaagaacggcgagcatcgcgaaatgacccgggaagcgctggagatcatgctgcgcatctggaccgaggacgagccctgggagcatcgcggaaagtactggaacgccaacggaatcgcgccgatgttcgagggtctgatgaggcgccacatcaagccgtaccagaagccccacccgcccatcggcgtcaccgggttcagcgccggctcggagaccctcaagctcgccggcgaacggggttacatccccatgagtctggacctcaacaccgaatacgtcgccacccactgggacgcggtggaggaaggcgcgctgcgcagcgggcgaaccccggatcgccgcgattggcggctggtgcgggaggtgctggtggccgagaccgatgagcaggcgttccggtatgccgtggacggcacgatgggacgcgccatgcgtgagtatgtgctgccgacgtttcggatgttcggcatgaccaagttctacaaacacaatccgtcggtgcccgacgacgaggtgacaccggagtatctcgccgagaacaccttcgtggtcggctcggtgcagaccgtggtcgacaagctcgaggccacctacgaccaggtcggcgggttcggccacctgctgatcctcgggttcgactacagcgataacccgggcccgtggaaggagtcgttgcggctgctggcccacgaggtcatgcccagactcaacgcccgcctcgccaccaagcccgccaccgcggtggtgtagccatggcggttcgtcaggtcaccgtcggctattcggacggcacgcacaagacgatgccggtgcggtgcgaccagacggtcctggatgccgccgaggaacacggcgtggccatcgtcaacgaatgccaaagcgggatatgtggcacctgcgtggccacctgcaccgccggccgctaccagatgggacgcaccgagggactgtccgatgtcgagcgggcggcgcgaaagatcctcacctgccagacgtttgttacctccgattgccggatcgagctgcagtatccggtcgacgacaacgccgccctgctggtcaccggtgacggtgtggtgaccgcggtcgagttggtgtcgcccagcaccgccatcctgcgggtggacacctctggcatggccggcgcgctgagataccgggccggccagttcgcccaattgcaggttcccggtaccaacgtatggcgcaactactcctacgcccatccggccgacggccgcggtgagtgcgagttcatcatcaggttgctgccggacggcgtgatgtcgaattatcttcgcgaccgcgcccagcccggtgaccatatcgcgctgcgctgcagcaagggcagcttttatctgcgcccgatcgtgcgaccggtgatcctggtcgccggaggaaccggcctgtcagcgatcctggcgatggcccagagcctggatgccgatgtcgctcacccggtctacctgctctacggggtcgagcgcaccgaagacctgtgcaagctcgacgaactcaccgagctgcgccgccgcgttggccgcctggaggtgcacgtcgtcgtcgctcgcccggaccccgactgggatgggcgcaccgggctggtcaccgacctgctcgacgagcggatgctggcgagcggtgacgccgacgtgtatctgtgcggtccggtcgccatggtcgacgcagcccgaacctggctggaccacaatggctttcaccgtgtcgggttgtactacgagaagttcgtggccagcggggcggcgcgccgccgcaccccggctcggctggattacgcgggcgtggacattgccgaggtgtgccgccgcggccgcggcaccgcggtggtcatcggcggcagcatcgcgggcatcgcggcggcgaaaatgctcagcgagaccttcgatcgcgtcatcgtgctggagaaggacggcccgcaccgtcgccgcgagggcaggccgggcgcggcacagggttggcacctgcaccacctgctgaccgccgggcagatcgagctggagcgcatcttccctggcatcgtcgacgacatggtgcgcgagggagcgttcaaggtcgacatggccgcgcagtaccgtatccggctgggcggcacctggaagaagcccggcactagtgacatcgagatcgtctgcgcgggaaggccgctgctcgaatggtgtgtgcgccgccggctcgacgacgaaccgcgcatcgacttccgctacgaatcggaggtggccgatctcgccttcgaccgcgccaacaatgccatcgtcggcgtcgccgtggacaatggcgacgccgacggaggcgacggtttgcaggtggtgcccgccgagttcgtcgtggacgcgtcgggcaagaacacccgcgtgccggagttcttggagcgtctcggtgttggcgctcccgaggccgagcaggacatcatcaactgcttctactccacgatgcagcaccgggttccgccggagcggcggtggcaggacaaggtgatggtgatctgctatgcgtaccgccctttcgaggatacctacgccgcgcagtactacaccgacagctcccgcaccatcctgtccacctcactggtggcctacaactgctattcgccgccgcgtaccgcccgagaattccgcgcgttcgccgacctgatgccgtccccggtcatcggggagaacatcgacgggctggagccggcatcgcccatctacaatttccgctatcccaacatgctgcggctgcgctacgagaagaagcgcaacctgccgcgggctttgctggcggtgggcgatgcctacaccagcgccgacccggtgtcgggtctgggtatgagcctggcgctcaaggaagttcgggagatgcaggcgctgctggctaaatacggcgccggtcaccgggatctgccgcgccggtactaccgggcgatcgccaagatggccgacacggcctggttcgtgatccgcgagcagaacctgcgcttcgactggatgaaggacgtcgacaagaagcgcccgttctatttcggtgtgctgacctggtacatggaccgcgtgctggagctggtgcatgacgatctcgacgcgtaccgggaattcttggccgtcgtccatctggtcaagccgccgtcggcgctgatgcgacccaggatcgccagccgcgtcctcggcaaatgggcacgaacccgattgtcgggccagaagacgttgattgcccgcaactacgaaaatcatccgataccagccgaacccgcggaccaacttgtaaacgcttaggagagcccaacgtgtcgcaggtccatcgaatcctgaactgccggggcacccgcatccatgccgtggcggacagcccacccgaccaacagggaccgttggtggtgttgctgcacgggtttccggagtcctggtactcgtggcggcatcagattcccgcgcttgccggcgcgggctaccgcgtggtggccatcgaccagcgcgggtatggccgctcgtcgaaataccgggtgcaaaaggcctaccgcatcaaggaattggttggcgacgtcgtgggcgtcctcgactcctatggtgcggagcaggctttcgtggtgggccacgactggggtgcgccggtcgcctggaccttcgcctggctgcaccccgaccgatgcgccggcgtggtgggaatcagcgttccgtttgccggtcgcggcgtgatcggcctgccgggcagcccgttcggcgagcgccgtcccagcgactaccacctggagctggccgggcccggaagggtctggtatcaggactatttcgccgtgcaggacggcatcatcaccgagatcgaggaagacttgcggggctggctgctcgggttgacctacaccgtttccggtgaggggatgatggcggcgaccaaggcggccgtcgacgcgggcgtcgacctggagtccatggacccgatcgacgtgatccgtgccggaccgctgtgtatggccgaaggcgcgcggctcaaggacgcgttcgtctacccggagaccatgccggcctggttcaccgaggccgatctcgatttctacactggcgaattcgaacgttccgggttcggcgggccgctgagcttctaccacaacatcgacaacgactggcacgacctggccgaccagcaaggcaagccgctcaccccgccggctctgttcatcggcggccagtatgacgtcggcaccatctggggcgcgcaggccatcgagcgtgcgcacgaagtcatgccgaactaccgcggcacccacatgatcgccgacgtcggacactggatccagcaggaagcgcccgaagagaccaaccggctgttgctcgacttcctaggcgggctgcggccgtgagctgcaccttcgacatggtcccggagaccgtcgatcatctcgacgaggtcgggctgcggcgggtcttcggctgctttccgtgcggcgtgatcgccgtctgcgcgatggtcgacgaccagccggtcggcatggcggccagctcgttcacgtcggtttcagttgacccgccgctggtatcgatctgtgtgcagaactgttcgacgacgtggccgaagttgcgcgaccgcccacggctcggtgtgagcgtgctcgccgaggggcacgacgcggcctgtatgagcctgtcgcgcaaggaaggtaaccggttcgccggggtgttctggagcgaattgtccagcgggggtgtggtgatcgccggggccggcgcctggctggattgccgcccgtacgcggagatcccggcgggggatcacctgatcgccctgctggagatctgcgcggtgcgcgccgatcccgagacaccgccgctggtgtttcacggtagccggttccgccggttggagtctcgatgaagacgaccgatgtgcgggtacgtcgtgcgatcacggcgatggcgggcggtcacgccgtggtcctgaccggcgaccccaatggcgatggctatctcgtcttcgccgcccaggccgcgacgccgcggctggttgcctttgcggtccggcacacctcgggttatttgcgcgtcgcgctgccgggcgccgaatgcgagcgactgcacctgccgcccatgtgtgaccgagacaccacgcattgcgtgtcggtcgacgttcgcggcaccggcaccggaatctcggcgagcgatcgcgcctggaccatcgcggcactggcttcggccacctccgtcgccgccgatttccaacgtccgggccatgtggtgcccgtgcaggcgcaagccgacggtgtgctgggtcggcggggacccgccgaggcggccgtcgacctggcccgcctggcggaacggcggccggccgccgcgctctgcgagatcgtctcgcccgataatcccgtccagatggcgcaccacgccgagtcggtcgaattcgccgtcgaacacggactggccatggtctcgatcggggagctggtggcgtatcgccggcggatcgagccccaggtggtccggtttacggcagcgacgctgcccacctgggccggcgcctcgcgtgtcatcggctttcgtgacgtttacgacctcggcgagcatttggcggtcatcgtgggtgcggtcggtgccggggtgcccgtgccgctgcacgtccacatcgagtgcctgacgggcgacgtgttcggctcgacggcgtgccgctgcggcgaggaactcaacggcgcgctggcgaggatgtcggctcagggcagcggcgtggtcttgtatctgcgtccgcccggacccgcgcaagcgtgcggcttgttcgcccggggcgatgcggcgaccgatgtcatgccggagaccgtgacatggatcctgcgcgatcttggggtgtatgcgatccgactttccgatgatgtgccaggatttgggcttgtcatgttcggggcgatccgagaagccagcacgttggcggccgcaggttgaaccatccagacctggccggcaaggtcgcgatcgttactggggcgggcgccggaatcggtctggcggttgcccggcgactcgccgacgagggctgccatgtgctgtgcgcggacatcgatggtgatgccgcggatgccgcggccaccaaaatcggttgtggcgcagcggcctgccgggttgacgtcagcgacgaacaacagatcatcgccatggtcgacgcctgtgttgccgcgttcggcggggtggacaagttggtcgccaacgccggtgtcgttcatctggcttcgctcatcgacaccaccgtcgaggacttcgatcgggtcatcgcgatcaatctccgcggcgcctggctgtgcaccaagcatgcggcaccgcggatgatcgagcgcggcgggggagccattgtcaacctgtcgtcgttagcgggccaggtagcggtgggcggcaccggcgcatacggcatgtcgaaggccggcatcatccagctcagccgcatcaccgccgccgaactgcgctcgtcgggcatccgctccaacacgctgctgcccgcattcgtcgacaccccgatgcagcagaccgccatggcaatgttcgacggggccctgggcgcggggggtgcgcgctcgatgattgcccggctgcagggccgcatggccgcaccggaggagatggccggcatcgtggtgttcctgctgtccgacgatgcgtcgatgatcaccggcaccacccagatcgccgacggcgggacgattgccgcgctgtggtgatcccctcgggtcaggcggtttcgaaagatcacgcgagacattgcctgcgacggcatgctacatatgtgattccggtgtattcgggcctctgcgcattgctttcgatcacaatgagcttggccgcgagccgtcttgttcgttgagccacggggccgttcgaatgcgttcgtcagaactccggctcggattctcgctagtttgctgacgtgtcatcgagagcaatcgacggcgacctcgagggccgtgcagatggcgcgcatccggatgtcggcgaggcggccaagccgattcaccaataccgcgaccgagacactttcgactgagtccaaattcaccgcggaacggcgcgggatcgggtcggaaccgggttcaagaacaacctcactggctagccctcggatggtcgtggtgcagggcgcgacaagtgcgcgtcgcagccgagggatcgcggcatcgcgcgacagcacgacgactggtcgccgaccgatctcagccatctcacaccaccacacctctccgcgcgccggaagtgcggtcacgagtctccagccgcccgccgccacgacgctagatcgccccactcgtcgggctcatcgaccgggtgcttgtcgtaggccgcatagctggcatccacctcggccgatcgatgacgagccagtaatgccgcaagggcctcatcgatgagggctgcgtcagtgattcctgcccgcatgtcgcgcgcacttgtcaagagtgcggcgtcgacagtagtgctcagccgtatgcgattcatgccactactatgccacactccggggcgtggatccgcctgatcggacgcaacgtgctcgatacgggcgaaacattggtcgctggacgaattgatgaggtctaccgcgcagcgcaacgtcacctgcaaccgggccgtcttcacggtgcgggttccgtgtcgatgaacgacgctgcggcacaacactttttgtacttgtgccccgagccgcaccagcactgttggttgcggcccggtggccaggccatcacatcgtggtcaccgtgtgctgtcaggtacgcggcatactcggcgcgggcctccggcgagtccggctcctgaccctgttcggcgcaccaggcagcgaagggtgccacgcggatcgcggcgaccgccagtcctgggaaaccagcctcggcgaattcgaccagcttttgctgcatcctccggcagtacagcgggtgcgccaccggcccgtccggaccggtcaccaggtcgctgccggcgaagtctggccacaggtcgagcgcccgctcgtagtcaccggcaggcagccacgccaatgacaccgcggtgatcggttcggcggattccgccgcgggtgtctcatcgacgggaggcacccggctggctccgttgtcactcatggtccaacatcctgccgcatcaccaccgcacgcggcatatgatgctcgcagtcgcggtggtgcggccttatcgccatgagcgaaatcttctgtatcactgatcattccgagcctatgacggcccggttcttgtcagtggtgcttcgtagaatccgaggcatgaggtcggacacgcgcgaggagatctccgcggcgttggatgcctaccacgcctcgttgtcgcgggtgctcgatctcaagtgcgatgcgttgaccaccccggaattgctggcctgtttgcagcgactcgaggtcgaacggcgccgccagggcgccgccgagcacgccttgatcaaccaactcgctgggcaagcctgcgaggaagagctcggcgggacgctgcgcacggcgttggccaaccggctacacatcactcccggtgaggccagccgccgcatcgccgaagccgaagacctcggtgagcgccgcgccctgaccggtgaaccgctgccagcgcagttgaccgcgaccgcggccgctcaacgtgagggcaagatcggccgagaacacattaaggagatccaggccttcttcaaggagttgtccgccgcggtggatctgggtatccgcgaggccgccgaggcccagctggccgaactggccaccagtcggcgtcccgatcacctgcatggcctggccacgcagctgatggactggctgcaccccgacggcaacttttccgaccaggagcgtgcccgcaagcgcggcatcacgatgggtaagcaggaatttgacgggatgtcacgtatcagcggtctgctgaccccggagttgcgggccaccatcgaggcggtgttggccaaactggccgcaccgggggcgtgcaaccccgatgaccagaccccggtcgtggatgacacaccggatgcggacgcggtgcgccgcgacacccgcagccaagcccaacgacaccatgacggtttactggccgggctgcgcgggttgttggcctccggtgagctagggcagcatcgggggttgccggtgaccgtcgtggtgagcaccacgcttaaagagctggaagccgccaccggcaagggggtaaccggtggtggttcgcgggtgccgatgtcggaccttatccggatggcgagcaacgcgcaccactatctggcattgtttgacggcgctaagccgttggcgttgtatcacaccaagcggttagcttccccggcgcagcgaatcatgttgtacgccaaggatcgtggctgctccaggccgggttgcgacgccccggcctaccacagtgaggtccaccacgtaacgccgtggacaaccacccaccgtaccgacatcaacgacctcacgctggcctgcggccccgacaatcgccttgtcgaaaaaggctggaaaacccgcaagaacgccaaaggcgacactgaatggctaccgccggcccacttggaccatggccaaccacgcatcaatcgataccaccaccccgagaaaatcctgtgcgaacccgacgacgacgaaccacattgacacccaatgaccgtggcattgccggtcacgtcgcaaccaagtactgcgaccgtagccgcgctcaaggctcggggtagacgagcgcggagagaggcacgttgccgagctgcctgccgacgacgagtatcccaatatcgtgctcacccatagcgtttcagcgggcaaccaacgattgccggccagcgaatctcggtggcggtagccagcatgaaggacgcagatgacctcgccgactacgggctgagcatagagcaggtgcgtgcagccgtcgactcgcatgtggacgtggaccattctgtctcagcgctgtgaccgcacggtagagttcgccatcgtggctgacgatgacgtcaccggtcaggatggctccggcgacggcaccgatccgcgcaccatgctgggccggtttgccaaccagcacaacgaatgggtgcgcctgagcgtgcgccacgtgctcgatgcgggcgaagcattggatgccggacagattgattaggtctaccgccactttcggcaggaaaaggcactggacacacgccaccgagccggccgtaccaccgttgacactcggcatcagcaacccggaaacagccgaacccctgatcatctggccgacctcgcccctggccgcaccgcgaccatcgggctgcgggattccagctgcctgcgcgtggaccgctacaacgaccaggcgtccgggcgagcgctcatcgagatccggttgtgcaacgaacgtgccacgccgatgccaatcccgatcgggctgtggatgtttcagaccaagctccacgtcaacgccggcggcgctgacgtgttcctgccggtctgcgacgtgctggagcaagacctcgccgagcgcgacgaggaggtacgccagctgaacctgcagtaccgcaaccggttggagtatgcgatcgggcggacttgctcggcggcctggtcggtgaacggctcgcggcgcccgtcggcagtgtggaccacctggctgccggtcgccgaaacaccccacacccgggcccggtcggtggagaacgcgctgttgtccatggacagtcgcggaggggttacgtagcggactggcgtcgttcgtcgcgggatatggaagctggtttcagggtcaggcggctgtcgcggccgagctgcccgagcacctgcacccgaccgccgacgagaggctggctcatgttgcggccgaaaaggaagcgctgcgctgcttccagttcatgaaccaggtgatgcgcgatcaccgtaaa

SEQ ID NO: 646 - DNA, 75216 bp, Mycobacterium tuberculosis
aagcttcaggttcgcggtccgaccctgttcgacggctacctgaatcaacccgatgccaccgccgcggcgttcgacgccgacagctggtaccgcaccggcgacgtcgcggtggtcgacggcagtgggatgcaccgcatcgtgggacgcgagtcggtcgacttgatcaagtcgggtggataccgggtcggcgccggtgaaattgaaacggtgctgctcgggcatccggacgtggcggaggcggcagtcgtcggggtgcccgacgatgatctaggccagcggatcgttgcctacgtagtcggctcagcgaatgtcgatgcggacgggcttatcaactttgttgcccaacaactttcggtgcacaagcgcccgcgcgaggtgcgtatcgtagatgcgctgccgcgcaacgcgttggggaaagtgctcaagaagcagttgctgtcagaaggctgagctacggcgaattatcgtgtaccgctggacagttacgctggcacactgttactccgacggcccggtgagcttagcgcatgggccttgttgccgcgccactgtagggcttccagggcgacggccacatggacggaggtgtggtcgagcggtcgcggtagcagccgctgagcggactcgagtctgcgcagaaatgtattgcggtgagtgtggagacgttttgcggcccgggaggcgttgcactgctcgttgatgaaggtcagcagggccgtttgtagatctgggctggcagactcgaggtctccaagcgtactcgtgatgaattcgcttgcagcatctggattttggctgatcaatgcgaccatcttaacgtcggcaaagaaggcgacccgctgggtcgaccgtagccgtgacaaggtgcgctgggtgatgagcgcttcgaggtggctgcgccggaacccctccaccccgttggcggtggtcccgatggcgatgcgcgccccgggtgcgttgtccaccgccgcctgcactgtgtcgatgtcgagtccgtcggcgtcggtcacccacgcccagcggctcgccgccccggcgaccaccgtcagcggtcgtgtcgatcccacggcgtggcagaacagatcagccgcccggtcgaggtagctgtggtcaccgtcgagctcgtcgctccagatgatggcagcggtatgggcacgactcagcgggtagcccaatttcgcttcggcccgttcggggctgataggggcgccatcgagaatcagcccgacgacctcgaggcgttcggcatgggtgctgcgggtcagttcgtcgtgttccgactgcacttgcgcggcgataccggtcagcgtggcctcgatgaagtcgttgacggagcgggccgacacgtctagcagctcgcgcagctcttgggggtcggaagtgagttcgaacgcaatccccatccagaaccgccacccgatgtgctcaccggttcgatagatgttgaacgctactgtgtccagcccccggcgcaccaggtctcgggccatccgcagtggctcggtgccgagattggcgggcacccgagcaccagggtcacgcaggttggccgcagcccagtacaccaggttggcgcgattggccgtctggacaaccttcgcaagcaccggatcgttggcgatcgccggattggccgcaatcgtggcacggtccagttcctcgatccactccgggctgggattgagggcgatgcgtgctccctcgcggatcagctcacgaattcgcggcgaaggttgttgccatgccacgcgccgatcttagggccagcgggtgcaatttgcacactatgttggcactattgtgccggattcacactgcacggccggtgtgtgcgcgaaatcacggtgtgggtctgctggatgagtcgaccgtgttgaacaacttgcgacacaccgcaatttgcgaaatccgccaccgaccgggcatagtaacccagctagtcgtcgttgtcgcgtcgaaccacatggtgaactgtgcggcgggtgcattttgcacatcaagtgggcgctgattgggaagatttacccttcggcggcggcggtaggtgcagattgcactttggctcatgctgattgaaattttttgacctgttgcggtccttgcgggctcgccatcattggcggcagttcgtcaccgacgaatcggggccaaggacgtaggcgaccagttcgcttgactgctaaccgctcctgatcgtacccgtgcgagtgctcgggccgtttgaggatggagtgcacgtgtctttcgtgatggcatacccagagatgttggcggcggcggctgacaccctgcagagcatcggtgctaccactgtggctagcaatgccgctgcggcggccccgacgactggggtggtgccccccgctgccgatgaggtgtcggcgctgactgcggcgcacttcgccgcacatgcggcgatgtatcagtccgtgagcgctcgggctgctgcgattcatgaccagttcgtggccacccttgccagcagcgccagctcgtatgcggccactgaagtcgccaatgcggcggcggccagctaagccaggaacagtcggcacgagaaaccacgagaaatagggacacgtaatggtggatttcggggcgttaccaccggagatcaactccgcgaggatgtacgccggcccgggttcggcctcgctggtggccgcggctcagatgtgggacagcgtggcgagtgacctgttttcggccgcgtcggcgtttcagtcggtggtctggggtctgacggtggggtcgtggataggttcgtcggcgggtctgatggtggcggcggcctcgccgtatgtggcgtggatgagcgtcaccgcggggcaggccgagctgaccgccgcccaggtccgggttgctgcggcggcctacgagacggcgtatgggctgacggtgcccccgccggtgatcgccgagaaccgtgctgaactgatgattctgatagcgaccaacctcttggggcaaaacaccccggcgatcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatcagcaacatggtgtcgatggccaacaaccacatgtcgatgaccaactcgggtgtgtcgatgaccaacaccttgagctcgatgttgaagggctttgctccggcggcggccgcccaggccgtgcaaaccgcggcgcaaaacggggtccgggcgatgagctcgctgggcagctcgctgggttcttcgggtctgggcggtggggtggccgccaacttgggtcgggcggcctcggtcggttcgttgtcggtgccgcaggcctgggccgcggccaaccaggcagtcaccccggcggcgcgggcgctgccgctgaccagcctgaccagcgccgcggaaagagggcccgggcagatgctgggcgggctgccggtggggcagatgggcgccagggccggtggtgggctcagtggtgtgctgcgtgttccgccgcgaccctatgtgatgccgcattctccggcggccggctaggagagggggcgcagactgtcgttatttgaccagtgatcggcggtctcggtgtttccgcggccggctatgacaacagtcaatgtgcatgacaagttacaggtattaggtccaggttcaacaaggagacaggcaacatggcctcacgttttatgacggatccgcacgcgatgcgggacatggcgggccgttttgaggtgcacgcccagacggtggaggacgaggctcgccggatgtgggcgtccgcgcaaaacatttccggtgcgggctggagtggcatggccgaggcgacctcgctagacaccatggcccagatgaatcaggcgtttcgcaacatcgtgaacatgctgcacggggtgcgtgacgggctggttcgcgacgccaacaactacgagcagcaagagcaggcctcccagcagatcctcagcagctaacgtcagccgctgcagcacaatacttttacaagcgaaggagaacaggttcgatgaccatcaactatcaattcggggatgtcgacgctcacggcgccatgatccgcgctcaggccgggttgctggaggccgagcatcaggccatcattcgtgatgtgttgaccgcgagtgacttttggggcggcgccggttcggcggcctgccaggggttcattacccagttgggccgtaacttccaggtgatctacgagcaggccaacgcccacgggcagaaggtgcaggctgccggcaacaacatggcgcaaaccgacagcgccgtcggctccagctgggcctgacaccaggccaaggccagggacgtggtgtacgagtgaaggttcctcgcgtgatccttcgggtggcagtctaggtggtcagtgctggggtgttggtggtttgctgcttggcgggttcttcggtgctggtcagtgctgctcgggctcgggtgaggacctcgaggcccaggtagcgccgtccttcgatccattcgtcgtgttgttcggcgaggacggctccgacgaggcggatgatcgaggcgcggtcggggaagatgcccacgacgtcggttcggcgtcgtacctctcggttgaggcgttcctgggggttgttggaccagatttggcgccagatctgcttggggaaggcggtgaacgccagcaggtcggtgcgggcggtgtcgaggtgctcggccaccgcggggagtttgtcggtcagagcgtcgagtacccgatcatattgggcaacaactgattcggcgtcgggctggtcgtagatggagtgcagcagggtgcgcacccacggccaggagggcttcggggtggctgccatcagattggctgcgtagtgggttctgcagcgctgccaggccgctgcgggcagggtggcgccgatcgcggccaccaggccggcgtgggcgtcgctggtgaccagcgcgaccccggacaggccgcgggcgaccaggtcgcggaagaacgccagccagccggccccgtcctcggcggaggtgacctggatgcccaggatctctcggtagccctcggcgttgacgccggtggcgatcaaggtgtgcactccgacgacgcggcctgcctcgcgcaccttgagcaccagggcgtcggcggcgaggaaggtatacgggccggcatcgagcgggcgggtccgaaacgcctctacggcttcgtcgagctctttggccatgatcgacacttgcgacttggaaagctttgtcacaccaagtgtttcgaccaggcgctccatccggcgagtggatactcccagcaggtagcaggtcgccaccacgctggtcagtgcgcgttcagctcgcttgcggcgctgcagcagccagtccgggaaatagctgccctggcgcagcttggggatcgcgacgtcgatggttgcggcacgggtgtcgaaatcacggtggcggtagccgttgcgctgattggaccgctcatcgctgcgttcgcggtagcccgccccgcacagggcgtcggcttcagcccccatcaaggcggcgatgaacgtcgagagcagcccgcgcagcagatccgggctcgcctgtgcgagttggtcagccagaagctgctcggtgtcgataagatgagaagaggtcattgcgtcatttccttcgattgacttttgctggtcgtttcgaaggatcacgcgatgaccgcccactactgggctacgacacgcccaccggccttacctgcccgtacaccacacccctggacgtaacttgacaccaatccacagcaccgagcagtgacagaaggtgccccaaggtgtggtgaaactcgctggacggtccccaggatgttggcagcacattcaccggacatgaccggagcaagaccggacatcctcccataccgtcgtcgccgtgtacatccgtagcccgtcctggcaggtgctgggttgaccaaaatcagcccaacacctgccacgacgatgaagcgggttgcgctggcatgtcttgtcggctcggcgatcgaattctacgacttccttatctacggcaccgctgcggcgctggtgtttcccaccgtgttcttcccacacctggatcccacggtggccgccgtggcctcgatggggacatttgctgtggcgttcctatcccggccgttcggcgcggccgtctttggatactttggagaccgcctcggccgcaagaagaccctggtcgccacactgttgatcatgggcctggcaaccgtgactgtcgggctggttccaacgacagtggccatcggcgccgcggccccactgatcctgacgaccatgcggctgctgcaagggttcgcggtcggcggcgagtgggccggttcggcgctgctgagcgccgagtacgcgcccgccagcaaacgtggctggtacgggatgttcaccgttgtgggtggcggcatcgcgctggtactgaccagcctgacctttctgggcgtgaactacaccattggcgaaagcagccccacattcatgcagtgggggtggcgcataccgtttctggtcagtgcggcgctgatcgccgtcgccctatacgtgcggttcaacatcgacgagaccccggtgttcgcccgggaaagggcagacgaaaaaacccgtttgggcccagccgaaacgccgattgcccaagtactgcggcggcagcggcgagagatagtcttggccgccggcagcgccgtttgctgcttcggcttcgtctacctggccagcacttacttggccagctacgctcaaacccgactggggtattcgcgcggcagcatcctgttcgacagtgtgctgggtggactgctgtgcatcgtgttcaccgcgctttcttccgctctttgcgaccaactcgggcgccgccgcgtcctattggccgggtgggcggtggctctaccctggtcgctgttggtcatgccgctgatcgactccggcagccccagtttgttcgcggtggctgtcgtcggcatgtatgccatcggcggattcggtttcggacccacggcatcgttcatcccagaactgtttgctactagctaccgatacacgggcagcgcgctcgcggcgaatctcgctggggttgccggcggcgcgctaccgccggtgattgccggcgcgctggtggcaacctatggcagctgggcgatcggtgtcatgctggccatcctcgcgttgatcagcctggtatgcacctatcggttgcccgaaaccgccggatcggccctcgtcagccgctagttggcgtgcaggtcctcgttgagggcaatgccctgaccgtcgcgggccagcacttcgaccgccccgctgacggaattgcggcgaaacagcaggttgctgctcccggagagctcacgcgccttgaccgaattgctgtcgggcatggtgaccctcgtgccggcggtcacgtacagcccggcctccaccacgcagtcgtcgcccagtgagatgcccagaccggagttggcgccgagcagacaacgcttgccgatcgaaatgacgtgtgttccaccgccagacagcgtgcccatgatcgacgctccgccgccgacatcggagccgtcgcccaccaccacacccgccgagatgcggccttccaccatcgaggcgcccagggtgccggcgttgtagttgacgaagccctcatgcatcacggtggtgcccggcgccaggtgagcgcccaaccgcacgcggtcggcatcggcgatacgtacgccggtgggcacgacgtagtcgaccatccggggaaacttgtcgacgccatacacagtcaccggtccgcggcggcgcagccgcgcccgcaccgcctcgaaaccgtctatggcgcagggtccgtgattggtccacaccacattggtcagcaccccaaacaagccgccggcgttcaacccatggggcgccaccaggcggtgcgacaagaggtgaagccgcaggtaagcatcgtatgggtcagcggcgacatcgtcgagcgagccgatgaccgtacggaccgcgatggtctcggtgcggcggtcgtcatcgcggccgatcagcgcggccagctcgacaggaacgtcggacaccgccagtcgtgacgtcgcgctggtgcccgattcggtcagttccggcgcgggaaaccaggtgtcgaggaccgatccgtcagcggcgagggtagccaggccgatgcctgctgctccagtcacggtcgacacgctacttgtgccgccgaacagacacaaaaccaccctatttcgaccagaatcgggtgcttttgcgtctgctcggccaactaagctagcgccgtgctggatttgcgcggggacccgatcgaattgaccgcggcgctgattgacatccccagcgagtcgaggaaggaggcacgcatcgccgacgaggtggaagcggcgttgcgcgctcaggcatcggggttcgagatcatccgcaacggcaacgcggtgctggcgcgtacaaagctgaaccggtcctcgcgggtgctgttggccggacacctggacaccgtgccagtggccggcaacctgcctagccgccgcgagaacgaccagctgcacggctgcggcgcagccgacatgaaatccggcgacgcggtcttccttcatctggccgctacactggccgaaccgacgcacgatctaacactggtgttctacgactgcgaggaaatcgattcggcggcaaacggtttaggccgcatccagcgcgagctgccggactggctatccgcggatgtagccatcttgggtgagcccaccgccggctgcatcgaggctggttgccagggcacgttgcgtgtcgtcctcagcgtgaccggaactcgcgcgcattcagcgcgttcgtggttgggtgacaacgcaatccacaagttgggtgctgtgctggaccggttggccgtctaccgggcacgcagcgtcgacatcgacggttgcacctatcgggagggcctctcggcggtgcgcgtagcaggcggcgtcgccggcaacgtgatccctgacgcggcctcggtcacgatcaactaccgctttgcccccgaccggtcggtggccgcggcattgcaacatgtccatgacgtgttcgacgggctcgacgtgcagatcgagcagacggacgccgcggccggtgcgctgcctggcctgtccgagcccgcggccaaggcgctggtcgaggccgccggcgggcaggtccgggccaagtatggctggactgatgtgtcgcgctttgccgctttgggcataccggcggtcaattacggcccgggtgatcccaacctggcgcactgccgcgacgaacgggtgcccgtcggcaacatcaccgcggccgtggacttgctgcgccgatacctgggtggctagcgctgctgtggccccaagcgtgctgccgccttggtcgcgtcggctgccgcggctgccatcccgatcccggccagctcctcagccaccgcggtcagctcggcagcatctccgtcggccaggccacgggcgtgcttgacgaggatatttcctacggtgcagtcgatttcggcggcgaggcgagtcaccgggtccaccgcacggatgtcgcccaaccgaaccgcgttatgccaggcgcatagggccaccgccgcctgcccggcccgctcagccgtccgggcggcctcccgggccgccgcgatggcccctgtcatgtcctgggccgccgccctggtccaggccctggccagcccgagctcgggtgcgaacaacgcggacttcgttccgtgccgagcttcagcgcgctgcagtgtttttgcagactcggcgatatggccttgctgcgcgatggccgttgccaacaacatcagcgacagcggaccccacgagtagccggttcgttccagtgtggcggcggccggctccagcatcgatgccgcggcgccgaattcgcctttggtgatcagtacgtacgccaacaacacttcaccgatggaccggccaggttgctgcagctaggcgaagtcggtgaaccgcttggccagctcctgagccggcgcgacgtcgcctgccagcagcagcgacgtgatctgagccaggcccacggtgaaccgcagcagccccggatgttcggcggccgacgcccgttcggccagccggtcaacgtcgccgaaccggcccattcgtgccgatgataacgcggcagcgctggcggcccaggccacggccatgtcgtcggcagccggtccggacagcacctcggtggccagcgtgatggcccgcggcaagtttccggagttcatcgcaaacgtggccgccagcgcatccagggtgctgcgggccgtgggctcggtcactcggctgcgggtcgtctgcagaaacgccgtggcgcgctcgggctcgttgagcatccagaaccgattcgccgcccggggtatcgcccaggccatcagctcggtctcggtcaattcggcgggattcaccgccgccagcaccgcgtcagcttcgcgaccgcgaccctgccaaccgagtgcgtaagccaagggcaggcgtgccgccagggcgtccgacctatccagcgctgcccgcgccaaccgttcggcaagccggacgtcgccgagccgcagggcctgcccggctgcggtcgccgcatccgtgaccgcggccggggtagcactggcggggacgtcgatggccagtgaggacagccgtaactgatcgctgacatggtcggatgggtgcttggccagctgcgcgaccagcgacacgcgcaatgcatgcgcgtgctcggccgtcaatacggcgcgtgcgcggtcggcgtacagcggatggccgacaaaaatctcgctggtatcgctgtcgggacccacccgcaccgcgccggcggcttcggcttggccgagcgtgtccaactgctcgccaccgaccagggccaccaggtcggtgcgcgccaacggttcggcgatggcgaggtagtcgacaacggcgcgggccggttccggcagggcgcacaggtactcgtcgatcacgccggacagcggccgacgatcctcgtctcgacagcgccaccggccgtccacgtgttcgagaccaccgccgtcgatgaggtggcgcagatacaacgggttgccaaggctgcgccgaaagagctcgtcggcgtcggcgacgtccagtgtcgcgtccagcgccgactccacgaacgccgcggtttgggccctgtcgagcggctcgatggcgacccgggtgagcaggtcatcggaccagagcgcagctatagcgtccggtggctcggcctccgaggcgacggtgaccaccagccgcgccgccccggcccgcgccagctggtacaccaaggtggccgacagcggatccaggttgtgcgcgtcgtcgaccaccagcagcagatcgccagcatcaccggtcagggaactacgcgccgcccgcagcagcgccgcgggccgcccaatgtcggctccggaggcgggcaggctgatcaaatggcggaaagcgccgaacgggatggcccgccctggagcggttcccaccacccagcgagcccggccgctcctgccgtcctcggacatgacctgctcggcagccagttgcgccagcagcgtcttgccgacgccgtgtggcccgaccagcaccaccccgcaccgatccggactgtcgacggccgcctccacgtgtttccagacgcgcatcgccggattttatggcggttgcgcccaacgacattcgagcgggggataggccaaaaatgtacgcggttcacatcggtggtctacgttctggtgtatgtcggcgaaaatcgacattaccggtgattggactgtggccgtgtattgcgcggcctcgccaacgcacgcggagttgctagagctggccgccgaagtcggcgcggcaatcgccggacgtggctggacgctggtgtggggaggtggccatgtttcggcgatgggggctgtcgcctcggcggcgcgagcctgcggcggctggaccgtcggcgtgattcccaagatgctggtgtaccgcgaactggctgatcacgacgccgacgagctaatcgtcaccgacaccatgtgggagcgcaagcagattatggaagatcgctcagatgcgttcatcgtgttgccgggcggtgtcggcaccctagacgagctgtttgacgcatggaccgacgggtatctcggtacccatgacaaacccattgtgatggtagatccctgggggcatttcgatggactgcgggcatggctgaacggattgctcgacaccggttacgtctcacccacggcgatggaacggctggtggtagtcgataacgtcaaggacgctctgcgggcctgcgcaccttcctgaggttggtcgacaaccaattcgacatttcgcaaacgaatcgagggcttacgtgtccgattactacggcggcgcacacacaacggtcaggctgatcgacctggcaactcggatgccgcgagtgttggcggacacgccggtgattgtgcgtggggcaatgaccgggctgctggcccggccgaattccaaggcgtcgatcggcacggtgttccaggaccgggccgctcgctacggtgaccgagtcttcctgaaattcggcgatcagcagctgacctaccgcgacgctaacgccaccgccaaccggtacgccgcggtgttggccgcccgcggcgtcggccccggcgacgtcgttggcatcatgttgcgtaactcacccagcacagtcttggcgatgctggccacggtcaagtgcggcgctatcgccggcatgctcaactaccaccagcgcggcgaggtgttggcgcacagcctgggtctgctggacgcgaaggtactgatcgcagagtccgacttggtcagcgccgtcgccgaatgcggcgcctcgcgcggccgggtagcgggcgacgtgctgaccgtcgaggacgtggagcgattcgccacaacggcgcccgccaccaacccggcgtcggcgtcggcggtgcaagccaaagacaccgcgttctacatcttcacctcgggcaccaccggatttcccaaggccagtgtcatgacgcatcatcggtggctgcgggcgctggccgtcttcggagggatggggctgcggctgaagggttccgacacgctctacagctgcctgccgctgtaccacaacaacgcgttaacggtcgcggtgtcgtcggtgatcaattctggggcgaccctggcgctgggtaagtcgttttcggcgtcgcggttctgggatgaggtgattgccaaccgggcgacggcgttcgtctacatcggcgaaatctgccgttatctgctcaaccagccggccaagccgaccgaccgtgcccaccaggtgcgggtgatctgcggtaacgggctgcggccggagatctgggatgagttcaccacccgcttcggggtcgcgcgggtgtgcgagttctacgccgccagcgaaggcaactcggcctttatcaacatcttcaacgtgcccaggaccgccggggtatcgccgatgccgcttgcctttgtggaatacgacctggacaccggcgatccgctgcgggatgcgagcgggcgagtgcgtcgggtacccgacggtgaacccggcctgttgcttagccgggtcaaccggctgcagccgttcgacggctacaccgacccggttgccagcgaaaagaagttggtgcgcaacgcttttcgagatggcgactgttggttcaacaccggtgacgtgatgagcccgcagggcatgggccatgccgccttcgtcgatcggctgggcgacaccttccgctggaagggcgagaatgtcgccaccactcaggtcgaagcggcactggcctccgaccagaccgtcgaggagtgcacggtctacggcgtccagattccgcgcaccggcgggcgcgccggaatggccgcgatcacactgcgcgctggcgccgaattcgacggccaggcgctggcccgaacggtttacggtcacttgcccggctatgcacttccgctctttgttcgggtagtggggtcgctggcgcacaccacgacgttcaagagtcgcaaggtggagttgcgcaaccaggcctatggcgccgacatcgaggatccgctgtacgtactggccggcccggacgaaggatatgtgccgtactacgccgaataccctgaggaggtttcgctcggaaggcgaccgcagggctagcggattccgggcgcagtctcgatacccgcactggacgctcgacggtaaccaggcactatggatgcgtgcgttcaacaccgccggcctcagccggtcgttcaacaccgccggcgttagccggccattcaacaccgccggcgttagccggccattcaacgctgtgcggccgtccagtcgcaggtgatcgtgcgctgatcatggcgatcgtcaaccgcaccccggattcgttttacgacaagggtgcgactttcagcgacgcggctgccagagacgcggtccaccgggccgtcgccgacggtgccgacgtcatcgacgtcggcggtgtcaaagccggcccgggtgaacgcgtcgacgtcgacaccgagatcacgcggctggtgccgttcatcgaatggctccgcggtgcttacccggaccagctgatcagtgtcgacacctggcgcgcgcaggtggcgaaggcggcctgcgcggcgggggcggacctgatcaacgacacctggggtggcgtcgacccggccatgcccgaggtggccgccgagttcggcgcgggcctggtgtgtgcgcacaccggcggcgcgctgccacgcacgcgacccttccgggtgagctacggtacgactacccgcggtgtggtggatgctgtgattagccaggtcacagccgccgccgagcgggccgtcgcggccggggtggcccgcgagaaggtgttgatcgacccggcacacgacttcggcaagaacaccttccatgggctgctgctattgcgacacgtggccgatcttgttatgaccgggtggcccgtgctgatggctttgagcaacaaggacgttgtcggggagactctgggcgtggatttgaccgaacggcttgagggaacgctggcagccaccgcgttggctgcggccgccggggcgcgcatgtttcgggtgcatgaggtcgccgccacccggcgggtgctggaaatggtggcatcgattcagggggtccggccgccgacgcgcacggtgagaggactcgcatgacagcatcggagctggtcgccggcgatctcgccggtggcagggcccctggcgcgctgcccttggacactacttggcaccgtcccggctggacgatcggggagttggaagcggcaaaggccggacggacgatttcggtggtgctgccggccctcaacgaggaagcgaccatcgaatcggtgatcgacagcatctctccgctggtcgatggcctggtcgatgaattgatcgtgctggactccggttccaccgacgacaccgagatccgggccatcgcctccggcgcccgggttgtcagccgtgaacaggcgttgcccgaggtgccggtacggcccggcaaaggtgaggcattgtggcgttcactggcggccaccagcggcgacatcgtggtgttcatcgactcagacctgatcaacccgcaccccttgtttgtgccatggctggtcggtccgctgctcaccggcgaaggcattcagctggtcaagagcttttaccgacggccgctgcaggtcagcgacgtgacgagtggggtgtgcgccaccggcggcgggagggtcaccgagctggtggcgcggccactgttagccgcgctgcggcccgagctgggttgtgtactgcagccgctgagcggtgagtatgcggccagccgggagctgctgacatcgctgccatttgcccccggctacggcgtggagatcggcctcttgatagacacgttcgaccggttgggcctggacgcaatcgcccaggtcaacttgggcgttcgggcgcaccgtaaccggcccctagacgagctcggcgcgatgagccgccaggtcatcgcgaccctgctgtcgcgctgtggaattcccgattccggtgtcgggctgacccagttcttgcccggcggcccggacgatagtgactacacgcggcacacctggccggtatcactagtcgaccggccgccgatgaaggtgatgcggccgcgctgaccgacaccgcgtcggcgccttagggcaagatcgatgacgtggcgttggtgttggtgtacctggtggtgctggtcctggtggcgatcgtgctgttcgctgcggcgagcttgctattcggccgtggcgagcagttgccgcccctgccgcgggcgacgacggcgacgacgctgccggcgttcggggtcacccgcgccgacgtcgacgcggtcaagttcacgcaggtgctgcgcgggtacaagaccagcgaggtggactgggtgctggaacggctcggccgtgagctcgaggcgctacgctctcagctcggggcgatccacgcctcgtcggaagacgccgaggccgagtctgacgcgtcaaacccttcgcgcggcgagaccgtcgtgcactaccgttctgaccccgcgtgagcggcgacgggctggttcgctgcccctgggcggaggttcgtccagggcccgatgcccagctgtaccgcgactatcacgacaacgaatgggggcgtccgctgtacggccgggtggctttgttcgagcgaatgagcctggaggccttccagagtggcctgtcatggttgataatcctgcgcaagcgggagaatttccggcgcgcattctctgggttcgacatcgacaagatcgctcgctacaccgataccgatgtgcgacggctactcgccgatgacggaatcgtgcgcaaccgcgccaagattgaggcgacgatcgccaacgcgcgcgcagctgccgatctggggtcgtccgaagacctatccgagctgctgtggtcgttcgcgccaccgcctcggccccggcccgtcgacggttccgaaattccctcggtcagcacggaatcgaaggctatgtcgcgtgagttgaagcggcgcgggttccgtttcgtcgggcccaccaccgcctatgcgttgatgcaggcgaccgggatggtcgacgaccatatccaagcatgctgggtgcccactgagcgaccttttgaccagccgggctgcccgatggcggcccggtgaagtcattgcgccggggcttgtgcacctgatgaacccgaatagggaacaataggggggtgatttggcagttcaatgtcgggtatggctggaaatccaatggcggggcatgctcggcgccgaccaggctcgcgcaggcgggccagcccgaatctggagggagcactcaatggcggcgatgaagccccggaccggcgacggtcctttggaagcaactaaggaggggcgcggcattgtgatgcgagtaccacttgagggtggcggtcgcctggtcgtcgagctgacacccgacgaagccgccgcactgggtgacgaactcaaaggcgttactagctaagaccagcccaacggcgaatggtcggcgttacgcgcacaccttccggtagatgtccagtgtctgctcggcgatgtatgcccaggagaactcttggatacagcgctggcgtccggcatgcccgtagcgctccgccgttgccgggtcggcgaccaaggcattgaccgcctcagccaatctggcctggtaaccggtcgcgtcgtcggcgtcgtaatgcaccagtgagccggtgatcccgtcggcgaccacctcggggatcccgccgacgtcggaggccaccacggcggttgcgcacgccatcgcttccaggtttacgatacccagcggctcgtacaccgacgggcacacgaaaactgttgctgccgaaagtatttctcgtagttgtccgatggtaagccggtcttggatccaaaacacgccagtgcgattgcgggccagttcggccaccgcgacgcgcacttcgtcggctacttccggcgtgtccgcagcacccgcgcagagcactagctgtacgtccgatctgaatcggtgcgcggctgttaccaggtggacgactcccttttgccgggtgattcgcccgacgaacaccgccatgggccggttcggatcgaccccgagctcggccagcaccgacccggtacgcgcgggcccggccggataccacgtctcggtgtcgatcccgttccggatgacgtgcaccaggttcggatccaggctgggatagacccgcaacatgtcgttgcgcattgcagaactgaccgcaatgaccgcgttggcggccagcaccgcggtctgctcgacccatgtcgatacctggtagccgccgccgagttgctccttcttccatggccgcaacggttcgagcgaatgtgcggtcaaaacatgcgggatgtcgtagagtatcgcggccagatgccccgccagagcggtgtaccaggtgtgtgaatgcacgacggtggccgcgctggcggcattggccatcaccaggtccgcggacaaggtggacagcgccgcgttggcgctgcctagcctcgggtcgggccgataggcaaatgcgcccgggcggggtgcgcccatgcagtgcacgtcgaccgcgcacagccggcgtaggtaggcaaccagttcggtgacatgtaccccggctccaccgtaaacctccggtgggtattcccgagtcaacatcgccacccgcataccccgcaccgtagtgcggtgacggggcggcccgcgtggcgggccgaggaggaggcggaggcggcacagcacccgtcgaacggggccaaacaccttgacggacagcccgtcagagcagtagccaggggcggattccccttggcagtggtttgcgggggccgataggtttgagccatgagagaagtgccgcacgtgctgggcatagtcttagccggcggtgagggcaagcggctttatccgctgaccgcggaccgggccaagcccgcggttcctttcggcggcgcctatcgattgatcgatttcgtactctcaaacctcgtcaacgcccggtatctgaggatctgtgttctcacccaatacaagtcgcattcactggaccgccatatctcgcagaactggcggttgtctggtctggcgggtgagtacatcaccccggtgccggcacagcagcgcctcggcccgcgctggtataccggctccgccgatgcgatctatcaatcgctgaacttgatctacgacgaagatccagactacatagtggttttcggcgccgaccacgtctaccgtatggatcccgaacagatggtccggttccacatcgacagcggtgccggcgcgacggtggccggcatacgggttccacgtgaaaatgcgaccgcgttcggttgtatcgacgccgatgactccggccgtattcgcagcttcgttgagaagccgctggagccgcccggaacccccgacgaccccgacaccacgttcgtctcaatgggcaactacattttcacgaccaaggtgcttatcgacgcgattcgcgccgacgccgacgacgaccactcggaccacgacatgggtggtgacatcgttccgcggttggtggccgacggtatggcggcggtctatgacttctccgataacgaagtgcctggtgccaccgatcgcgaccgagcatattggcgcgacgtcgggacgcttgacgcgttttacgacgcacatatggacctggtgtcggtgcacccggtgttcaacctgtacaacaagcggtggccgatccgcggggagtcggagaacctggcgccggcgaagttcgtcaatggcggctccgcacaggagtcggtggttggtgccggcagcatcatctcggcggcctcggtgcgtaattcggtgctgtcgtcgaacgtcgtggtcgacgacggcgcgatcgttgagggcagtgtgatcatgcccggcacccgcgttgggcgcggggcggtggtgcgccacgcgatcctggacaagaacgtcgtcgtcgggcccggtgagatggtcggcgtggatctggagaaggaccgggaacgcttcgcgatcagcgccggcggcgtggtcgccgtgggcaagggtgtttggatctaggtccggttagcggcgcgagcagacacagaatcgcccatttcggcacgaaattgggcgattctgcgtctgctcggcgcggtggggcgcgccggctagggccctggcggcccgggttggccgaacagctgcccgccagcgccgccgcgagcgccggccgcggcggccccgcgccacctcccacgccgccgttgccgatcaaccccccgggcccgccgtcttggcccggtccgccattggcgccgtcaccgatcgaacagtgcctgggtgggagcgttgatcacattcagcacgtcttgctgcacgctctgcgccacagcagcgttgacggcttcggcagccgcataggccccgccagcgccggtcagggcttgtacgaactgctgatgaaacgccgtcgcctgcaagctaagcgcctgataggcctgagcgtgtctggcgaacagtgacgccacgaccgccgatacttcatcggcacaggcggccagcatcgcggtggttggggctgccgcggcggcattggccgcgctcaatgccgagccgatgcccgccaaatccgttgccgccgatgccagcacgtccggggcgccaccagatacgacatggccacaccttatcgtgggctcgttacggcatgcggtgttttcgacggactcgtcaccgacgccgcgcgtgtgacgcgcgccgtcagccagcgctcggcaacccgggctacccagggacctccggtatcagcaggtgcgcgtcgtagcgtgggccccagtgcagcgtgacacgaccacgcggcgggcgtgggtaggcggccgggaattggccggtgagcgggttgcggggggacaaccagcgtccgccaaccaccagtcgtaactgttcgccggcgcggaacaatgtcgccgacgggccaagcgcgacatcgacggcgacgacctcgccggcggtgaccggccggggccgagcacacgccgggaccggctcccatggctgcgagagctcggggtcgagctcgcgcagcgagacccgctgccagccggtggtcacccggtcacggccccagccgtaggacccctcaaacgcaacgaactggccatcgcgccacttctccactccgacgaacaggttcgcgtcgtcgcagccatccaattgaacccacaggcgggcggccatcgggccggtcaactcgatgtcttcggggatcgtccaattgaatgctgctgcccgagagcgagtttggaacctgatgctgcccgccgtcggcggcggctcggttgccagcagccccggcccggcgagatacattggccgccaacgcgtgccggcaagcggccactgggtctcttcacgcaccgcggtgatggtgtcgcgatcctcacgcacctcgaggcgaacgctgcgcgaaccggaggagccggccagcgcgtctcgcaagaacttcagctgctcggacagcgcggtcgctgagtagaaggtctcccatttgcccccgcgatgggtatacagccgggcgtgaccgcagccgctgcgggtaaaagcgcggatcgacccgcggctgtgcaagttgttgtccgagaagctaccgcagaccagcatcggaaccttgatcgccgacaggtcgggtactcgcgagcgccagaaatcgtcgcgcagcgggtgagcctcttgcatctgctccatgtcgtaggtctgacgtgtgcgacgtcgcaccccgcgcgaccacagccgggtgaaccctgactcccggatgccgccgggaaaggccaagtcgcggtaggcgtcggtgaaaccctcccacgggcagatcgcccgcagcgccggcggttgcagcgcggccacggcgtactggctaatggccagataagacacccccagcatgacgacgcgcccatcactccatgcctggtcggcgagccatcccaccaggtcgtaggtgtcctcggcttcctggtgtgacagcaggtctccggtaccgtcggagcggccgcagccgcgcgaatccgcattgaccacgacgaagccctgcgcggtccaccacgccgggtccggcgcctcccagccggtcagcgccgagaaggtcagcggcttcggctggcgcagcatccggtattgtggtgagaacgtccaccggttgccccgccgccgcggcagggcgtccttgccgtagggatggatgctcgcgatcaccggcctagccccaccttcggcgctacgaaagacgttgatccgcagcagcgttccgtcgcgggtaggcacctcgacgtcgcgttctatgacgacgtcggccggcggatcggtgacggtgatcggcggcttggcgacgccgcgaacccgctccagcgcataccggagagcaccgggacgtcgccacggccggtccaaggcaggtgacgggtttctggccacgcccgttaccctaaagctattcgaccgctaccacacgtagggcaccaaccggtagcgcaccagttgccggtattcgcggtacccgctgagttcttgcgtcagtagtttttcctcgtcgaggatgcggaacaccaacaccagtgtgccggggacgaggatgaacatcgcccagtaagagcccagtgccagcggtatgcctgtcatcatgaccacgttcccggcgtacatcgggtgtcggacaattttgtagagaccgtcggaggccaatatctggcccgcctccaccctgaccgtcgaggcggcatacctgttctggatgaccaccagcatggcgatgccaaggcccgtcatcactaggacgtcgccgatcacgcacaccgcggctggcactgacgaccaaccataacgatggtcgcacgcgctcagcaccatcatcgcgaagaaccccagaaaagcgccgatgacgatgaacttctgaatcgttcggccctccgcgagcggaccgctgcgcatgcgacgttgaagggccgcgggatcgttgcgagccagatagattgtggggccaatcgtggtgctcacaaatgcggcgaggaacacccacgcctgccaatagtcgaacgtgccggctggcccgaataggagcgcgccgaaaacgacgagtcctaacacgccccatatgaatatcttcagcccaatgtgcatggctcctcctagcagcgaacgtcacgccgtcggaaggccatggcgcccagggtgatcagggctgcatctatggccagcagccacagcaacggcaccgcggtgaaatcgccgccgccgacccgcgggatgtgggcgaacggctccaggttgagcagcatctgcgggaaccccgccaacgagccgagcaggtacagcgcgatgaacccgaccagcacgccccacgccaccggcgtgaaccgcggcgccaacccgaacaatcccacggtcaccgccgataacaaccacacggccggcagttgcacggccgcggtgccgaccacggtgggcagcttgccgccgacgtcaccgacggtcatgccgtaggcgagtccggccgccacgccggagatcagggtcgccaccgccgatccggccagcgccatcgccagatggcttgccagccaatgggtccgggaaaccgccccggcgagcagggtctcggcccgcagcccggtttcctcttggtgcagtcgtagggtcagcgagacggcgaatgcggcggcgaccatgccgatcatggtgaaggccagcgcaaggaaggcctgttccagtgcgccggtgccgcccatccgggtgacgatgtcacgcaccgcggtgttatcgcccagctgatccccgatgccgtgcaccacactgcccatcaccagcccgtacaggcacaggccgacggtccacaacagcagggagccgcgattgagccgccatgccagcccgaagggctcgctcagcatgggcccggcggtgccggcgccggggcgttcggcgatcagtccggcaccgacatcacggccggcgcgtaatcgataggccagcacggtaagcacggccgcggtcgccagcgacagcagcagcacccaccaacgctctcccgcgtagggtctgacctgcagcgaccaccccagcggcgagcaccaggacagcgtgcccgagccggcatcaccgatggcacgcagcgcgaacgcggtgcccaggacggcgaacgcgaccgcgcgggtgaatcgggcgctcggcgacagctgcgcggccaccgcggccaccgccgtgaagaccatcccggaggccgccagcgccacgccaaacgctaccgacccggccggagccacatcggtggcaagcagacccaatgcaccgatcgcgccggtcgcgatcgacgcaccgaacgacagcagcagcgcgccggtgaggttggcgtagcgcccgaccacggtcgaatcgatcaattcggcacggccgctttcctcgtccgcgcgggtgtgccgaatcaccgtgaggatgaccgccaccgcgatgagggtgtgaaacatcccggctttccagattccgaccgcacccaggctgtcgttgtagaccggcccgtagagcgcgcgctgtgccgggctggccataatggcggccgccgcggcggcgcgggcggaccggtcggggtaaaccgtttcgacgctggcgatgtacacggtggccagcggcaccgacagcagcagcacccacagcggcaacgacacccggtcgcggcgcaggtacaggcgcagcaaccccagtgtgccggtgaagcccgaaccgcggtgtggtgcacggtgtcctgcgggtctcgcgcgatcgatgaccgtactgctcacggcgttgccacctgttgctcggctgcgacctcggggcccaggctgtagtggcgcaggaacagctcctccagggtgggcggctgactgaccaggctgcgcacaccggcgtggccgagcacttggatgagttctctcaggctttcgctgtcgacctgggcgcgcactgtggtgccctcgatgctgatgtcctcgactcccttgatttggctgaggtctcctggatcaccgatcatttcggccttgatcgaggtgcggctgaggtgccgcaaggcgtctagtgaaccgctttcgacggtcttgccggctcggatgatggtcaccttttcgcacagcgcttcggtctcggccagaatatggctggacaacagcaccgtcacaccgcgttggcgtgcttcgccgatgcactgctgaaacacgttttccatcaacgggtccaggccgctgctcggctcatccaagagcagcagagtggcgtgcgacgacaatgccgagatcagggagaccttttggcggttgcccttggagtaggtgcgcgccttcttggttgggtccaggccgaagcgctcgatcagttccgcgcgacgagcgttgtcgatgccgcctcgcatgcgggccagcaggtcgatggtctcaccaccggtcagcgacggccacaatgtgacatcgcctggaacataggcgatgtggcggtgcaggtcgacggcgtcggtccaggggtcaccgcccagcaaccgcacgcttccgccgtcggccttcaccaggcctagcaggatgcgcagggtcgtggacttgcccgcgccgttggggccgaggaagccgtgcacttcgccctcgcgcaccgtgaggtcgagcccgtcgagcgcccgcaccgacccgaagtgcttggtcagtccgcgaatctcgatgggcacctggtggttgtcagccgacatgtgcttctccttgttgagcttcggccaggaaggcctcgtacatggcgcggtcggccagcaggccttcggtgtagacctccagggaaggcagcaccatgtcgtgcgcgtagtcgcgtaacgctgcacggagatcggttgggttttcgtgcatttgcagataaagcaggaagcctccgcctccggtgatcgccagaaaccgagcacgggcgcgcgggtcgcggctgggcttgaccgtaccggcgcgtactccttcgtccaggtactcctcggcgttgtcgatcatcttctgccacagcatcttcgccagctcgccgccggattgcatgctgcgcaccaggtatgccatcagcggtgcgtaggattcgatctcggccatctgcgcgagccaggtggtcgggtcgttggacttcagtgccgcagccttgctgctgcggatctcttcggcgacgaagtcgtcgcaggccttgcgcagaccttccttggaaccgaaatggtggatgaccaatgccgcgctcacccccgccgcttcggcgatggctcgcagcccgacaccgaatccgtgccgaccgaactgttcgatggccgcctctctgatcctggcgtgcgcggtcagatcggctgaacgcatgttcaggatattaaacgtacgttcatccccggtcaagggagggcgccgttgggaatccgtgaaggccgcgaactttgccgagcagacgcaaaatcgccctggaacgcacggttcagggcgattttgcgtctgctcgccgaattagtcccgcacggctgccagcacgccgtcgcccagcggcaccagtgccggagtgagccgttcatcctcggcgataagccgggccgcctcgcgaaccgcgatcacctcggcgtcgcgcgccccgggatcaccggcccgaccgcccagcgccgcccggtgcacgacgatgaccccgccggatcgcagcagccgcaccccctcggcgacgtaatctggctggtcgatcgggtcggcgtcgatgaataccaggtcgtaggatgcgtcggcgagccgggtcagcacctcttgggcgcggccgctgatcagcctggtacgcgacggcccgatgcccgcctcggcaaaggcctgcctggcaaggcgtagatgctcgggctcgatatcgatggtggtcaagacgccgtcgtcgcgcatgcccgacaacagccacaggccgctgacgccggccccggtacccacttcggccaccgccttgcctccgctgagcttggccagcaagcacagcaacgcacccaccgccggtgttaccgccccggccccgatgtcggttgcgcgctcgcgggcgccggccaggatcacgtcttcagatattgacccctcggcgtgcgcccagagtgattcgcctcggctgggggccggctggccaggcatgtcgtcgtgtccgggggtgccgtccatgcccgcagcgtatgtccaattggcgacgccgtcgggcaggcgcgcctggttcgaacgccggccgagcaccgagctggacgcttgcggctgtacccgacacgcccggcgtgccggacgcgacgaaggtcactttgactcgatattccctggacagcgcaggtaacggtatggtttctaagccaaagctcagattgctcatatatggcccatacgccggtacgcgacggtaattcccatggaactcctcggcggaccccgggttgggaatacggaatcgcaactttgcgttgccgacggtgacgacttgccaacttattgcagtgcaaattcggaggatctcaatatcacgaccatcacgaccttgagtccgaccagcatgtctcatccccaacaggtccgcgatgaccagtgggtggagccgtctgaccaattgcagggcaccgccgtattcgacgccaccggggacaaggccaccatgccgtcctgggatgagctggtccgtcagcacgccgatcgggtgtaccggctggcttatcggctctccggcaaccagcacgatgccgaagacctgacccaggagacctttatcagggtgttccggtcggtccagaattaccagccgggcaccttcgaaggctggctacaccgcatcaccaccaacttgttcctggacatggtccgccgccgggctcgcatccggatggaggcgttacccgaggactacgaccgggtgcccgccgatgagcccaaccccgagcagatctaccacgacgcacggctgggacctgacctgcaggctgccttggcctcgctgccgccggagtttcgtgccgcggtggtgctgtgtgacatcgagggtctgtcgtacgaggagatcggcgccacactgggcgtgaagctcgggacggtacgtagccggatacaccgcggacgccaggcactgcgggactacctggcagcgcaccccgaacatggcgagtgcgcagttcacgtcaacccagttcgctgaactactcaacggccgccgagcgcgtcggttcggctaccgcatggttgccaatcggtcccgaatcctggggttttaccggctggcgatggttttccggcaccgcgccgcgctacattcgagataccggtggctcgctaggtggcggaaggaggtggtgatggccgaccccggaagcgtgggacatgtgttccggcgcgcgttttcctggctcccggcgcagttcgcctcccagagtgacgcgccggtcggcgcgccgcggcagttccgttccaccgagcacctgtcaatcgaggccatcgcggctttcgtcgacggcgagctgcggatgaacgcgcacttgcgggccgcgcatcacctttcgctgtgtgcccaatgcgcggccgaagtggacgaccaaagtcgtgcccgcgccgctctgcgcgattcccacccgatccgcatccccagcacgttgctcggattactgtccgagatcccgcgttgtccacctgaaggtccatctaaaggttcgtctggaggttcatcccagggcccgcccgacggggctgcggcaggcttcggcgaccgcttcgctgacggcgatggcgggaatcggggccggcaatcgcgggtgcgtcgctagccggtgagccacttgtcgcagcgcatggcggggttgctgcgagttcatggcgagtggtcgcgatccgtggatactagggtggacacggacaacgcgatgcctgcacgttttagcgcccagattcagaatgaggatgaggtgacctccgaccaaggcaacaacggcggcccgaacggcggaggccgcctggcgccgcgcccggtttttcggccaccggtcgacccggcgtcgcgtcaagcgttcgggcgtccgtccggggtccaagggtcctttgtggccgagcgtgtgcgcccgcagaagtaccaggaccagtctgacttcacaccgaacgatcagcttgctgacccggtgcttcaggaggcgttcggtcgtccgttcgcgggcgccgaatcgctgcagcgccatcccatcgatgccggagcgctggcagctgagaaagacggtgccggccccgacgagcccgacgatccgtggcgcgaccccgcggccgcggccgcgctggggacgccagcgctagccgcgccggcaccgcacggtgcgctggccggcagcggcaagctgggtgtgcgcgacgtgctgtttggcggcaaggtgtcctacttggcgctgggcatcttggtcgctatcgcactggtgatcggcggcatcggcggtgtcatcggccgcaagaccgcggaagtagtcgatgcgttcaccacgtcgaaggtgaccctgtcgaccactggcaatgcccaggaaccggccggccggttcaccaaggtggcggccgccgtggccgattcggtggtgaccattgagtcggtcagcgaccaggagggcatgcaaggttccggcgtcatcgtcgatggccgcggctacatcgtcaccaacaatcacgtgatctctgaggcggccaacaatcccagccagttcaagacgaccgtggtgttcaacgacggcaaggaggtgcccgccaatctggtgggtcgtgaccccaagaccgacttggccgtcctcaaggtcgacaacgtcgacaatctgaccgtggcccggctcggtgattccagcaaggtacgggtcggtgacgaagtcctcgcggtcggcgcgcccctggggctgcgcagtacggtgacccagggcattgtcagcgcgctacaccgccccgttccgttgtcgggcgagggctctgacaccgacaccgtcattgacgcaattcagaccgacgcctcgatcaaccacggtaactccggcggtccgctaatcgacatggatgcccaggtgattggcatcaacaccgccggtaagtcactgtcggatagcgccagcgggctgggctttgcgatcccggtcaacgagatgaaattggtggcaaattctctgatcaaagacggaaagatcgtgcatccgacgttgggcatcagcacccggtcagtaagcaacgcgatcgcgtcgggcgcgcaggtggccaatgtaaaggcgggaagtcccgcgcagaagggcgggatcttggagaacgatgtgatcgtcaaggtcggtaaccgcgcggtcgccgactccgacgagttcgtcgtcgccgtgcgccagttggctatcggccaggacgctccgatagaggtggtccgcgagggtcggcatgtgacgctgacggtgaaaccggaccccgatagcacctagagtgttcgccaacatcggttggtgggaaatgctcgtcctcgtcatggtcgggctggtggtgcttggcccggagcggctcccgggtgccatccgctgggcggcaagcgctctgcggcaggcgcgcgactatctcagcggtgtgaccagccagctacgtgaggacattggacccgaattcgatgatctgcggggacatctcggtgagctgcagaagctacggggaatgactccgcgggctgcgttgaccaagcacctactggatggcgatgattccctgttcaccggagacttcgaccgaccgacgccgaagaaaccggatgcggcgggctcggcggggccggacgctactgagcagatcggtgcggggcccatcccgtttgacagcgatgccacctagatcggtgacggccggcggtcgggcccggcgagctaacacccgagcaacggcggcaggccggccaccgagtcgatcacgtggtgcggccgggtcgcgctggcgccggccagccagcgatccagcgtttgctggcggaacttgccggtgcgcaccagcacacccgtcatgcccaccgcctgggcggccagcacgtcgttgtgcagatcgtcgccgatcatgaccatctgctgtggatcgacaccgacgcggtcggcggccgccaggaatccctcggccgcaggcttgccgatggcggtggcggtcttgccgcaggcctgttccattccggtcaggtacatcccggtgtcgatgcgcagcccgtcggtggtgttccaggtcatattgcggtgcatcgccaccaccggaacgccgtcgagcatccacccatagacccggctgagcgtgcggtgatcgaactgggggccggcactgccgagcacgacgacgtcgggggcttcggggcaatcctcgggaccgatctcggtcgacaagacgacgtcgatgccgggcaagtcctcggtgatgtcgccgttgttcaccaggaagcaccgcgcgccgggataggcgccgtgcaggtactcggccgtcagcaccccggccgtgatcacgtcgtcggcggcgacggggatccccgcggcacccagcgcctcggcgatctgccggcgggtgcgcgtcgtggtgttggtcagatacgcgcaggcgattccccgatgggtcagttgccgcacggtctcggcggccccgggaatcgcgcgccacgacagcaccagcacgccgtcgatgtcgaacagcaccgccgcggccatcagatgcgccacgtccacacgatatccgtcagttagaccgtcgacatcgacaccagcgcggaaaaaccccagtgagcatcgcgctgacgtcgatctcgacggtgaggttcatcctggctcaggatccctcaagatccgtggcgcaaccacacactgtcggccacccagggcgacgcggcgccggccaccgaccacgccagctccgcgggcacatcgagcacctgataacccttgcggcccgccacggtggccgccacgagcgtcgccacccccgccctccgctggaacagtgtctggcgcaccgtccagccgatgatgccggtgcaggcgatgcaatcgcggcgacgctgtaggctgccggcgcgcgcaaccaaccagccgtcggcgacgcggtgcccgagtgatcggacccgatcgacggccagcccagcgcaacccgcggtcaacaccgcccacagtgtccacgcccaccccggcacgccgagaatcggcgccgctgcgatcagcgcaactccggccagcgtcgggaccaacagcgcccgggtccacctgcgccgggcggcggccgggccgtgccggcgcagcggccccgctgccgcgtcggtgttgtcgatcaggtcggtcagcacggccgtcgcggtctcgaacggacatggtggcagcagcatcgacgactggccctcgccatgcacgccggtcatcactgcgtccagccgagcaccgcgcaataaccgcaccagcagtggttcacgcaaggtggcgccacgcagccggcgcatgtcgtaggtgtgctcgcgcacccgcagcagcccgtgccgcaggtgtagcaccccttcttgaccgctgccgccgcggcgcagcagcagattgccgtaggtcaaccaggagaacagcaccgccaacagtgccgatacacccaccaccagcagcacagtgaccgccaccaccagtaccaccccggcgcgttgcgcggcgtccaccgcggacctggcgaaaccggattccgggagtcgcacggccagtcccgtttggtagccaagcccgatcaccgccccgatcatcaccaggcccgaaaagctcagcggcgcataccgcaaccacgacgactgccaccgggccagcacccgaccggtcggctcgacgggtgccagcgactcggccagcagcagcgcgcgcagcctgggcacccgtgccgagtcgaccgcgtccagttcgaaggcggcctcaccgcgggcctcctggccggtgcccacccgcagcaccgtcaaccccaacagccggtgcaacagccgcgcctcggtctgcaccgagcgaatccggttgcgcggcacggagaccgcgcgccggctgagtatgccggtacgcagcgacacgttttcgtcgtcgatgcggtaggtggtgaaaaaccaacgcagcacgccgaatacgaccgtcacgccgagcgccgccagcggccagaccgggttgccggttgccgaccccagcaccacggacccgatgagtaccgggagctggcgcagcatctcgtgcaccggatgcaccagcagcatccgcgggctgaggcggtgccaatcgtgtggccggtcggtcatgtcgcgtcctcgccgcgcagcgcggcgatgtcggtcagctgcgccaccacccgatcggcgacgtcggtgtccaacgcctcgatgtgcaccgcgcccgccgaggacgccgtggttacggtgacgttggccagcccgaacagccggtccatcgggccgcggtaggtgtcgacggtctgcacccgggaaatcggtgtgatgcggcgctcctgcacgagccaaccggtgcgggtgaatacggcctgcgggctgatctcccaacggtgtacccggtaacgccagagcgggaccaccccgatgtgcaccaccatcgccaccgcggtgagagcggccgcggccaggtgcggccagggcggctggggatgcaccgcccaccacaccagctgcgcgatcaccgggagtatccagcccagcgacgcggacagcgcccacatcaccggcgcctggctgctcggtcgatgggccggctcggcgagcgcgaggtgatttctctgcggtccggttgcgcttggcacatttcgagcatggtccaacggaaaccgaacacagtgatcgggggtcgtggttatcgtttgagctagcgctcaacaagatgcgtgccaactcaccctgccccggggaggcgcgatgagtcgacagtggcactggctggcagcgacgctgctcctgatcaccaccgccgcgtgcagtcgtccgggcaccgaggaaccggattgcccgacgaaaataaccttgccgcccggtgctacgcccaccacgaccctcgacccgagatgcatagtgcgcgcgaccaccaccggcacagccgacggcgatgcggcgtcgcgctggaccggaaccgtgcggatcgccgggttctatgcctcgatctgcaacgcggtatgggacgggaacgtcagccttgcgggaaaggacgagctgaccggcaaggctacgcttatcctcgtcgaaaccagttgcccgggcaaggttgtcgccggcgaactcgtgctgaaggggaacgtcggttcggacagcctcgcgatcacctgggcgcaccccgaactcccgcagcgggcgttcgacctcggcgccggacagggcacgatccgccgatcgggcgaccgtgccgagggaacgttcaactcggatatgggtgggggcaccgagttcttcttgacgtggtcgctgacgatgcgtaactgacgatcacaacgtgcccaccaaaaacagagtagacaacagtcgacaattcccttgtactccggcgctatgaagtcgatctccgtcggtgagctgcgccagaatcccgctcccatgatcgccgacctcgaacggggtgagccatacgcgctgacccgccacaaccaccggatcggaacgatcattcctgccgtctcgtcggcaacactcattccccggaaagcctagtacgccgagcagacgcaacggcacccaatttcgaccagaatcgggttcttttgcgtctgctcacgcggtcaacgctagcgtcgtgtcgggtccaaccccagcgacatgcccgccaatccgcgtcgtcgagtcgacaagccgtcggcgatgctatgcagttccttgccgatcgccgagtccggcgagctcaacacgagcggtacgcccgaatcgccggcggccaccagtgcggggtccagcgggatctgacccagcagcggcacgtcggcgccgaccgcacgcgacaaccgctcggcgaccagccggccaccgccctcgccgaacacctgcatcgtggtgccgtccggcagcgtgagccccgacatgttctccacgacgccgacgatgcgttggcgggtttgcagcgcgatgctgccggcccgttcggccacctccgcggcggccagctgcggggtggtgaccaccaggagttcggcgttggggatcagttgagccaccgagatggcgacgtcgccggttccgggcggcaagtccagcagcagcacgtccagatccccccagtacacgtcggccagaaactgctgcaacgcccggtgcagcatcggcccgcgccacaccaccggggtgttgccctgggtgaactgggctatcgagatgaccttcacctggtgggcgatcggcggcaggatcatcgactcaacctgggtaggccggtcggtggtgcccatcatccgggggatagagtggccgtggatatcagcgtccagcaccccgatcgacaggccgcggacggccatcgcggcggccaggttgaccgtgacggtggactttccgactccgcccttaccggaagccacggcatacacccgggtcaaggaatcgggttgcgcgaacgggatgacgggttcgcgggtatcgccacgcaactgcttacgcagctcggtgcgctgctcgtcgctcatcacgtccaagctgacccgcaccgccgaagtgcctggcacgtcggcgaccgcccgggtgacacgctcggtgatttcggacttcttcgggcagccggcgatggtcaggtagatctcgacgtgcacgctcccatccgggccggtgtcgatgcttttgaccatccccagttcggtgatggggcgccgcaattcggggtcgattaccttgcccagcgcggtgcgtatcgccgcgttcaggtcgccatcacgagttccggacatcaccgccgagtgtaggcggcttggcatacggccgagtggtcagccggcaggagccggcgccggcggcgccaggcccgcgtcgccaggcgggccggccaatggatccggaggtgggggagcggcaggtaggaatggaggtgggggagcggtaggcgggaacggcggcgcgcccactggcgggccatgtgagccaatgcagatcagcgtgcagccgggcatcggcgccgatgggtcaggtgccatccacgggaacatcggcggtggattgagcgccgcctggcgcggggtcaagtcgatcagcggcaggtgcgccatggggccatcggcggtcaggccgttgacattgatcggcaagccgggcccgagaccctccggattctcgaggtgcgcgtcgccgagtggtggtggcggaccggtgatcgggggcaagtcaaccgggaacacaccggtggcgtagccggcggcccagcccagtacgttctgggcgtaaggcatcgagttgttgtagcgcaggagcgcggccatgacctgcgccgggtcgcgcaggttgagcccaccgctacacaggtagcgggctgcggccaacgtggagtcgaacaggttctgcgggtcagccacaccgtcgtcatcgccgtcggtggcgtaccgagcccaagtgccgggcaagaactgcattggccccatcgcgcgggcgtacgtgacgcgattgccgacgctgctttggatgatgatctcgttgcctggcagggtgccgtccagcgttgggccgtagatcggctggatcgcggtgccgcgcgcgtcggtggcgccgccgtttgcgtgcatcgactcgatgcgcccaatcccggccagcaagttccaactgacgccacagccaggggcggcagcggccatcttcagctcggcgttgcggtaggcggacagtgccatggccggaatgccaagcgcaccaggcgaattcacgatcatcggtggtggtggagccgatatggtagctaccgccacgcggaagctggtcggcgggcgcttcatggcgatgacgaccggaccggacaggtctatgccggacgcggcgaccgcggccaccggggtgataacggcgtgcaccggcgcggttctcccggggaataccggagccgcgctgccgaccgcactggcgaataccaacggggcaatcgctgccacgccgaatgccggcgcccgcgttaggcgacaagctccccgccgcactgcagcgacggccgggcgtgcaccccagcgtcccccaatgtgcactcgaccgtcctcagtgtgtgagccgtcggaaacctatgtcttcttagcttctttcttcgtttcgtgaactagatcaccatacataactcttgtcacgggagtggcgcaatggccgactcggtaatcaccccgatttcttggcgtgctgctccgcctcgtcggccacccgcggctgcgccacatccggatccgtcggctgcagctccgccaacagagcgcgcaggctgtccagttcgtggcgcaggtagtcgcgcgtggggacctcgccgatggccagccgcagcgctgccagctcgcgggcgttgtactcggtgtcggccttggtctgtgcggcccgccgacgatcctcttcgaacaccgcgcggtcacgcttttcctgacggttctgggcgagcagaatcagcggtgcggcgtacgaggcctgcgtggagaaggccagattgagcaggatgaaggggtacggatcccagcgcaagccgaccgcaaacaggttcagcacgatccatgtcagtacgagcagcgtctgcaccagcaggtaacggccggttccgaaaaaccgtgcgatggattcggttgtcctgccgacggcctcgggatccagccgcggggcgagcgtgcgcgatgtgcgtggggtgtacagacggcgcggcgcgaagggtttgctcaccgtggtcctccgggtctgtccggtgctccggaggggtcgagctccggcatatctacacgccagtcatgcggcaatagatggtcgagcaggtcgtccacggtcaccgctcccagcaggtggttctcgtcgtcaaccaccggtccgcacaccaggttgtaggcggcgaagtagcgagtcaccgcggccagcggggtctccggagtgagcgtgagcaggtcagtgtccacaactccgccgaccagctcggccggcgggtcacgaagcagccgctgcaaatgcacacaacccaggtagtgcccagtgggcgtggccgtgggcgggcgcgcgacgaacaccattgacgccagggcgggggtgagatcgggatcgcggacccgcgccaacgcctccgcaatcgaggtgtccggggtcaacaccaccggatcggaagtcatcaatccgcccgccgtgtcgggggagtgcgtcagcagccttcgcacctgcccggagtcgccgggatccattcgtgtcagcagcaactcggcttcggtcggattcaggaccgcgagcagatcggcggcgtcgtcgggatccatctcctccagcacgtcggccgcgcgttcggtgcccagttgcgacaacacctcggcctgatccagttcgggcagctcctgcaggacgtcggccaagcgcttgtcgtggagcgccttgaacacctcgtggcggcgcttcggcggcagcccgcggatggcgtcggccacgtcgaccgctttccatccctcgaactggtcgagcagctgtgccacgtcttgacccggcatcgccaaggccgacggcgtcaaccccgccacgttgtgccagtccacgacgtgcactgggcagcgccgtcggagccgacgttgggtgcggacggcgaccctagtcaccatccagtcgcgacttcgggtttgctcgacacccaggtcggtgaccacgacgtcgacgccggccagctcgggtagtgcgggatcgttgaccttcaccagggtgtcgagcacttgacccagcgccagagcctcgcctggccgctgctcgaagcggtgcagtgacacgttgccggtgctcagtgtcaccgcgtgcggctcgatcgcggcgacccgcagaatcggtatgaatatcttgcggcgggtcgccaaatcgaccaccagcccgagcactcgcggttgttggcggacaatgctgatgctgatcacgacatcgcgaacgcgcccgaaggattcgccgagcggtcccagcaccgacatccgcgagagccgcgccaggtacaccctgttgaccgatcccatgattgagagcctaggcagctgccttccggatcaaccgagggtgggccaatgtcgcctaatgctaagggatagcgaagatccccgcgatcatgtagaccagcagggtcgcgatgccaatcacaatgccggccaccgccaggccgtagccttcttcgcgtgtctgcttgatctggttgatggcgatcgcgccgaacacgatgcccacgatcgagccgatgcagcaaagcacaccgacgagcgccgagatcagtgagacgagcgccatggtgttcatgccgggctgcgatgggccgtagccgtctaggtagcccggctccgggtagtagccgcccggagatccaccgtatggcggaggcatgggcgggtatggtatgtcgccgtagcctgctgaagaagtgccggggggtggatatccgggcggcgcatagcccccgggtggcatcggcggtggatagccggtcggatacccgggctggtaagcaggcgggtaaccggacggcggatacgccgggggcgggtggttggccatcggcgaagatgccggcggcgcccaaggagcgtcagcaatgggctgttcggggggccgctcaccgaccggaggcggtccacccgcggcgtcgtgcgcactctcgccagaggagccgctgggagccgtcatggtgatcaacctatcccggcaacgatgctcgccgttcggtgggcctcggtcgctcgcgggttgagtggatagtgtgccgggagtagctggacctgactggacatgaaacgatggcgctgaaaaaggggggcggaggagaatgagaaccgatgactagcccattccagcccagacaggttcccggttcaacacccgccgccgcaggtgcgggtcgacgtggtgtgcccgcattgcccaccccgccgaaaggttggccagtcgggtcgtatcccacctatgccgaggcgcaacgtgcggtcgactatctatccgaacagcagttcccggtccagcaggtgaccatcgttggcgtggacctcatgcaggttgaacgggtcacaggccggctgacctggcccaaagtgcttggtggcggcgtgctgagtggcgcctggctgggcctgttcatcgggttggtgctcgggttcttcagtcccaatccatggtccgcgctggttaccggcctggtggccggggtgttcttcgggctgatcacctctgcagtgccgtacgcaatggctcgcggcacaagggatttcagctcgaccatgcaactggttgccggtcgctacgacgtactttgtgatccgcaaaatgcggaaaaggcacgggatctgctggcgcgtctggcgatctgaagcccggacgagaggcaaatgtggtcatgagtcgcgggcggataccgaggctgggcgctgccgtactggtggcgttgacgaccgcggcggcggcgtgcggggccgatagccaggggctggtggtcagcttctacacaccggccaccgacggcgcgacgttcaccgcaattgcccaacgctgcaaccaacagttcggcggccggttcaccattgcgcaggtcagcttgcccaggtcccccaatgagcaacggttacagctggcccgacggttgaccggtaacgaccgcaccctggacgtcatggcgctggatgtggtgtggacggcggagttcgccgaagcggggtgggcgctgccgctgtcggacgacccagcggggctggccgagaacgacgccgtcgccgataccctgccaggcccgcttgcgacggccggctggaaccacaagctgtacgcggcacccgtcaccactaatactcaattgctttggtaccgaccagatttggtaaatagcccgccaacggattggaatgccatgatcgctgaggcggcccggctgcacgcggcgggcgagcctagctggatcgcggtacaggccaatcagggcgagggcttagtggtgtggttcaacacgctgctggtgagcgctggtggatcggtgctctccgaggacggccggcacgtcaccttgaccgatactcccgcacaccgagcggctacggtcagcgcgctacagatcctcaaatcggtggctaccacgcccggcgccgacccctcgatcacccgcaccgaagagggcagcgcgcggttggccttcgaacagggcaaggccgcgctcgaggtcaattggccgttcgtgtttgcgtccatgctcgagaacgcggtgaagggtggtgtgcccttcttaccgcttaaccggattccgcagttggccggcagcatcaacgacatcgggacgttcacgcccagcgacgagcagttccgcatcgcgtatgacgccagccagcaggtgttcggtttcgcgccctatccggctgtagcgcccggccagccagccaaggtgacgatcggcgggttgaacctggcggtggccaagacgacccgccatcgagcggaggcattcgaagcggtgcgttgtctgcgtgaccagcacaatcagaggtacgtctcgctcgaggggggtctgcccgcggtgcgggcgtcgctgtactccgatccgcaattccaggcgaagtatccgatgcacgccattattcggcagcaactcaccgatgccgcggtgcggccggcgacgccggtgtaccaggcgttgtccatccggctcgcggcggtgctgagcccgatcaccgagatcgacccggagtccacggccgacgaacttgccgcgcaggcgcagaaagccatcgacggcatgggcctgctcccgtgacctccgttgaacagcggaccgccaccgcggtcttttcccgtaccgggagccgcatggccgaacggcgactggcgttcatgctggtcgcacccgccgcgatgttgatggtggcggtgacggcctatcccatcggttacgcgctgtggcttagcctgcagcgcaacaacctggccaccccgaacgacaccgcgttcatcgggctgggcaactatcacacgatcctgatcgaccggtattggtggacggcgctggcggtgacgctggcgatcacggcggtttcggtgacgatcgaattcgtcttggggttagcgctcgccctggtaatgcaccgcacgctgatcggcaaggggttggtgcgcaccgcggtgctcattccgtacggcatcgtcacggtggtcgcctcgtatagctggtactacgcctggacgccgggcaccgggtatctggccaacctgctgccgtatgacagtgcgccactgacgcaacagatcccgtcgttgggcatcgtggtgatcgccgaggtctggaagacgacgccgtttatgtcgctgctgcttttggccgggttggcgctggtccccgaggatctgctaagagcagcgcaggttgacggcgccagcgcctggcggcggttgacgaaggtcatcttgccgatgatcaagccggcgatcgtggttgctctgctcttcaggaccctggacgctttccggattttcgacaacatctatgtgctgaccggcggcagcaacaacaccggatcggtgtcgatcttgggctacgacaacctgttcaaggggttcaacgtgggccttggttcggcgatcagcgtgctgatctttggctgcgtggccgtcattgcgttcattttcatcaagttgttcggcgccgcggcgcccgggggtgagccaagtgggcgttgaacgggtgggcgcgcggcgcgccacgtattgggccgtcctggacactttggtcgtggggtacgcgttgctcccggtgctgtggattttcagcctgtcactcaagccgacgtcaacggtcaaggacggcaagctgattccgtcgacggtgactttcgacaactatcgtggcatcttccggggcgacttgttcagctcagcgctgatcaactccatcggaatcggcctgatcaccaccgtgatcgcggtggtgctcggcgcgatggcggcctacgcggttgcccggctggaatttccgggcaagcggctgctaatcggggctgccttgctgatcacgatgttcccgtcgatctctttggtcacaccattgttcaacatcgaacgtgccatcggcctgttcgacacctggccggggttgatcttgccgtacatcaccttcgcgttgccgctcgcgatctacaccctgtcggcgttcttccgggagatcccttgggatctggaaaaggcggccaagatggacggtgcaacgcccggtcaggctttccggaaggtgatcgtaccgctggcggcgccgggcttggtgaccgctgcaatcctggtgttcattttcgcctggaacgatctgctgctcgcgttgtcgctgaccgctaccaaggcggcgattaccgcgccggtggccatcgccaacttcaccggcagttcgcaattcgaggagccgaccggctcgatcgcggccggcgcgatcgtgattacgatcccgatcatcgtctttgttttaatcttccaacgacggattgtcgccgggttgacctctggcgctgtgaagggatagcgcgatggccgagattgtgttggaccacgtcaacaagagttaccccgacggtcacacagcggtgcgcgacctcaacctcaccatcgccgacggcgaatttctgatcctggtagggccttccggttgtggcaagaccacgacgctgaatatgattgctgggcttgaagatatctcgtcgggagaactgcgcatcgccggtgagcgggtaaacgagaaggcgccaaaggaccgtgacatcgcgatggtgttccagtcgtacgcgctttacccgcatatgacggtgcgccagaacatcgcgttcccgctgaccctggcgaagatgagaaaggccgacatcgcgcagaaggtctccgagactgcaaaaatccttgacctgaccaaccttctggatcgcaagccctcacaattgtcgggtggtcagcgacagcgggtcgcgatgggcagggcaatcgtgcgccatcccaaagcattcctgatggacgagccgctgtcgaacttggacgcgaagttgcgggtccagatgcgcggcgagattgcccagctgcagcggaggctgggtaccaccaccgtctacgtcacccacgaccagaccgaggcaatgacgctgggcgatcgcgtggtagtgatgtacgggggcatcgcacagcagatcggcacccctgaggagctttacgaacggcccgccaatctgtttgtcgcgggctttatcggctcgccggccatgaatttcttccctgccaggctgaccgcgatcggactgaccctgccgttcggtgaggtgacgctggcccccgaagtccagggggtgatcgcagcgcacccgaaaccggaaaacgtcatcgtaggcgtgcggccggagcatatccaggacgcagcattgatcgacgcgtatcaacgcatcagggcgctgaccttccaggtgaaggtcaacttggtcgagtctttaggcgccgacaaatatctgtatttcactaccgagagcccggctgtgcactcggttcagttggacgagttggcggaggtagagggggagtcggcgttacacgaaaatcagttcgtggcaagggttcccgccgagtccaaggtagccatcgggcagtcggtcgagttggctttcgataccgccagacttgccgtcttcgacgccgactccggtgcgaacctgaccattccgcaccgcgcctaatggcggcgagcggacacataagcccccgccacgccgaaggatttggagctttttgcgtctgttcgccgacgcgaagctagagccagtttctgttgcggaagacgtggtagaggaacagacagataaggaccatcccgccgatcactgtcgggtaaccccacctggagtccagctcgggcatgaagtgaaagttcatgccatagatgcccgcgatcatggtggggaccgcgatgatacctgcccacgcggatatcttgcgcatgtccatgttttgctgcatgccgacccgggcgagcgcggcctgcaccagcgagttgagcatgtcgtcgtagctggcgatctggtcggcggcctcggtctggtggtcggcgacgtcgcgcaggtagcgccgcacttctttcgaaatgaggtctttgctctcggtctgcatgcgctggaatgcggtcgatagcggattcacgcaccggcgcaactcgaccacttcccgcttgagcagatagatcggttcgatgtcgagcttgcggcccggcgcgaacgctacttcctcgatgctgtcgatatcggtctccatgagattggtcacctcgaggtagtggtcgaccacgtagtcggcgatcgcgtgcatcaccgcatacggtcccaaccgcaaatgttcggggtcggcatccatccgcttacgcacctcggataacccgccgtgttcgccgtggcggacggtgaccacgaaatccttgccgacgaagatcatgatctcgccggttttgacgatctcgcgggccagtaccaccgattcgtgcgggacgtagttgacggtcttgaggacgaggaacagcgtctcgtcgtagcgctccaacttgggtcgctggtgcgcgtgcacggcgtcctcaacggctaacgggtgcaacccgaaaacgtctgctacgtcctgcatctggttttcatcgggctcgtgcagcccgatccagacgaacgcctcctgcccggtcagttcgatctcgcgcacctcgcgcagcgcggcggcgtaggtgtacttgccgggcagtcgctggccgcagacgtagacaccgcagtcgaccaaggcttgggccggtggctgggcaacggggtgtgcgttcggcggctggggtcgcgcgaccggtcgcagcacttcgggcaatgcgtcaaaccctgggaacacgtcaacctccgatcgcggtggatctgatcgggcggtgctccaggttacgcgtcccggtatggaacttggtaaacgtcagtcgtagctgtgggggttggaccccagatgtccgtccggtgccggtgcgctagtttcaacccgaagccaagtccgtaaggagcagaaccgacgtgagcgctagtcctctcaaggtcgccgttaccggcgccgccggccaaatcggctacagcctgttgttccgcctggccagcggctctttgctgggccctgaccgtccgatcgagctgcggctgctcgagatcgagccggcactgcaggcgctcgagggtgtggtgatggaactcgacgactgcgctttcccgctgttgtccggggtggagatcggttccgatccccagaagatcttcgatggtgtgagcctggccctgctggtcggagcccgcccccggggcgcgggcatggagcgaagtgacctgctggaggccaacggcgcgatcttcaccgctcagggcaaagccctcaacgctgtcgccgcggatgacgttcgcgtcggggtgaccggcaaccccgccaacaccaacgcgctgatcgcgatgaccaatgcgcccgacattccccgcgagcggttctcggcgctcacccggctggaccacaatcgggcgatctcgcagctggccgccaagaccggcgcggcggtcaccgacatcaagaagatgacgatctggggcaatcactcggccacccagtaccccgacctgttccacgcggaggtcgccggaaagaacgcggccgaagtggtcaacgaccaggcctggatcgaggatgaattcatcccgacggtcgccaagcgcggtgcggcgatcatcgatgcgcgcggcgcgtcgtcggccgcctcggccgcgtcggcaaccatcgacgctgcccgggactggttgctggggacgccggcggacgattgggtctcgatggccgtcgtctccgacgggtcctacggggtgccggagggcttgatctcctcgtttccggtcaccaccaagggcggcaactggacgatcgtgagcggcttggagatcgacgagttctcccgcggccggatcgacaagtcaaccgccgagttggctgacgagcgcagcgcggtcaccgagctcggcctgatctgagcgcaggtcagccgcgcactgagcggagcccgagtcatcttgacgtgtgtttgtccaggcatcatgatgacctgtatgcgcaccaccttgacgctcgatgacgacgtcgtccggctggtcgaagacgcagtgcatcgcgaacgccgcccgatgaagcaggtcatcaacgatgcgctgcgcagagcgctggcgccgccggtgaaacggcaggagcagtatcggttggagccgcatgagtcggctgtgcgttccgggttggatctggccggcttcaacaagttggccgacgaactggaggatgaggcgctgctggatgccacgcgtcgggcccggtgatcatccctgacatcaatctgctgctctacgcggtcatcaccggattcccgcagcaccggcgcgcgcatgcgtggtggcaagacaccgtcaacggccacacccgtatcgggctgacgtatccggcgttgttcgggttcctacggatcgccaccagtgcccgcgtgctcgccgcgccactgccaaccgcggatgcgatcgcctatgtgcgcgagtggctttcgcagccgaacgtggacctactcacggcgggtccgcgccacctggacatcgcgttgggcctgctcgacaagctcggcacagccagccacctaaccaccgatgtgcaactggccgcctacggcatcgaatacgacgccgagatccattccagtgacaccgactttgcccgattcgccgatctgaagtggaccgacccgttgcgcgaataatgactgccgctctgccctcgggtcagccgttcaggccgtgctgaccgttggcgccggtagcgccttgagtaccgggatcgccgggggcgccggggttgaacccggtcccgccgccgccgcccgcgccgccgttgccgcccgcgccgccgaggcccccggccgcgccggagccggggctgcccgactgtccgaacagtccgcccgcaccgccggtcccgccgtttccgccgacgccaccggccccgccggccccgccgtcgccgccgttgccgccgtcaccgccgtcgccgtcctggttggccatgccgtcggcgccgatcccgccgttgccgccgttgccgccgctgccgccttgagcgccgatgcccccgtcgcccccgacgccgccgtcgccgccggcgccgcccgtgccgagcagtagcccgccgcgacccccgctgcccccaaagccgccggcgccaccaacgtcagccgaggcaccgacgccgccgtcgccgccggcaccaccattgcccccggtggagttgcccccaggaggattatcttgattggcatttcctccggcgccgccggcaccaccgggagcgccgataccgccgttcccgccggcgccaccgttgccccctatgctgttgccagcatttgcaacattggcgctgccacccgctccgcccagccccccgccgccgccggctccgccgtttccgccggcgccgccattgccgccgacagcgtcaccaaagccgctttgagcggcgccaccgttaccgccggcacctccggaggcgaagttggcgccgtcgccgccgtcgccgccggcacccccggacacgtcggtctgcccaaggttggttccatccccgcctatgccgcctgcaccaccgcccacgccggggttgactgcgttgctgcccgagccggcgtcggtcccgttgccatcgggtccggtagtgccgtcggcgccatcggtcgcgtgcgtgacctgatgggacaccgggttttgcccgttggcgccggccgctcctgccgctccggctccacccgcccccccgttgccccatagcccggcgttgccgccgtggcctccgttgccgccattgcccccgatctgggtggccgccccaccgttgccgccgagcccaccgttgccgtatagccacccgccgttgccgccggcaccgccgttcgcgccgggcccgccggctcccccggcgccaccgttgccgatcaacccggccgcgccgccgcgaccgccgggctggcctggggtgctactcgagccgccgttgccgccgttgccgtacaacaagccaccgtcgcccccgttttgtcccggcccgccgttggcgccatcgccgatcagcgggcgccccagcaacagctgggtgggcccattgaccacatccagcaccgcttgcatcggggaggcattggcggcctcggccgccgcatacgagccggccgccgaactcagtgcccgcacaaactgctgatgaaatgccgccgcctgtgcgctcagcgcttgataggcctgggcgttcccggaaaacagcgacgcgatggccgctgatacctcgtcggcacccgcggccagcagccccgtggtcggggcctcggccgccctgttagctgcggccagcgccgagccgatgccctccaaatcagcggccgcggccaccaacacgtcctgcgctgcaatcagatactccatcgcggggcctctctcgcggcgagattgaccaacgggtcggcacgaagcgtgtcccgttgcttgacggtgcattgcgtgtttgcctggatccccgcgccgacggtgtggatcgggcccagtaccctcaagcccgtgccaactgcatctgtcgcggtgactatcggctcagacacttcggtgtgagaatcaccaggatcctcgcgctgctgcttgccgtcctgcttgcagtgtctggcgtggctggctgctcggccgacaccggcgatcgccacccggagttggtggtcggatccacgccggactccgaggcgatgctgctggccgccatctacgtcgcggcgctgcggtcgtacggttttgcggcgcacgccgaaaccgccgccgacccggtggcgaaactggactcgggcgcgttcaccgtcgtacccgctttcaccggtcagatgttgcagaccttgcaacccgatgcgtcggtgcgctcggatgcccaggtataccgcgccatcgtctcggcccttcccgagggcatagccgcaggcgactacaccaccgccgcagaagacaaacccgcgttggtggtgactcaatccaccgccaaggcctggggcggcggcgatctcagcgagctgcccagccactgccgcgggttgttggtcgggcgcgttgccggcgcccacacacccgcggccgtgggaccgtgccggctgcccgccccgcgtgagtttcggaatgacgcaacaatgttcgccgcgctgcgggccggacagctggtcgcggcctggaccaccaccgccgaccccgacatccccgcggacctgatcatgctgaccgacggcaagcccgcgctgatccgggccgagaacatcgttccgctgtatcgtcgcaacgcgctgaccgagcggcaactgctggccgtcaacgaggtcgccggcgtgctggacaccacggccctgatcgggatgcgccgccaggtggccgcgggggccgacccggcggcggtggccgccggctggctcgccgaacacccgctgggacgttgagccgccacgagcgtccgggtcgacgcgatgacacaccgcgtcggccgaacaaccttcgggcgcgctttcctcaccagccgtcagcgcgggcggggtatcaaccggccggtgatgatcggaaagatccgctgatatccggaaccggtcagccggaccaccaggtccagtaccttggcgtcgacacccaccaacacccgggccttgttcttggccacccccgtcaggatgatctgcgcggcccgctgtgggctgagatgggccacccgcttatcgaacgtctcggccagctcggcctggtcaagtccctcggcggcggtggcgttacgggcgatcgcggtcttgacaccgccggggtgcaccgtcgtcaccttcaccgggtgacccgccaacgccatttcctggcgcagcgcctcggtaaagccgcggacggcgaacttggccgagttgtaggccgcctgacccggcgccgaaaacaacccgaacacgctggagatgttgatgacgtggccgtccccggaggcgatcaaatgcggcaggaacgccttggtgccgttgaccacaccccaaaaatcgacgtccatcacccgttcgatgtccttgaactggctgacctcgatatcgccggtaaaggcgatgccggcgttgttgtagatctggttcacagtgccgaagtgctcgttgaccgcatcggcgtaggctaggaaggcttcgcgttcggttacgtcgagtcggtccgtcttgaccggcgtgctgatcgcctttagccggtgctcggtgtctgccaggccgtcggtgtcgacgtcgctgatggccaccttggcgcccgagcgggccagctcgattgccagcgcctgcccgatgcccgatcccgcgccggtgacaacggcgacctttccggcgaacccctccatgacgtaccctcccttgtctcggctgccatcaggttagccggtacccggggtacggcttaacgtggccggcacgggttcattcggtagctggcactgcgacgagcgatgtggatgatctcgactcggtggtggccgtcgtcgatggcgtagacgacgcggtaatcaccgcggcgggctgagtggaggccttcaaggtcattgcgcagcggcttgcccaacctatgcgggttgttaagcagcggtccgaaaacaaactcgacacatgcggcggcgatcttttcgggtaagcgttgcaggtcgcgtgccgctgtcgcggtgatcgccacgtggtagggatggtcgtcgctcaccgcgcggtgtaacggttgcggatctcgtcgttgctcacgaagcgccctgcggcaacatcggcgaggccttcacgaatggcctcgctggcgccaggggtgcgtagcacctccagcgtttcctcgatggacgccaggtcatcggccgagatcaataccgccgccggatgaccgtgccgggttatcgtgatgcgctcgtgtgtcagctcaacttcggcgacgtactcagagaggcgattgcggacttcgcccagtgggacaacagccataaccgcgattgtagctaaaagtatggctaaaccctgtacgccgagcatcggcttaccgagccgaacgcctcgtcgctgtttgatgtctcctcgagcgttcggctgagcgaactcagccgaacgcctcgtcgaggatctcctgctgttcgacggcgtgcaccttcgacgagcctgacgacggggctgacatcgcccggcgcgagattcgcttgatcccggccaacttgtcaggcagcagctcgggtagttcgagcccgaatcgcggccacgcaccctggttggccggttcctcttggacccagaagaactccttgacgttctcgtagcggtccagcgtttcacgcagtcgacgcctgggcagcggggcgagctgttcaagccgcacgatcgcgaggtcattgcggttgtccttggccttgcgggcggccagctcgtaatacagcttgccactggtcagcaggatccggctgaccttgttgcggtctccgatgccgtcctcataggtgggttcctccagcactgagcggaacttgatctcggtgaagtccttgatttcgctgacggcggccttgtgacgcaacatcgacttgggcgtgaacacgatcagcgggcgttggatgccgtccagggcatgccggcgtagcaggtggaagtagttcgacggagtcgacggcatcgcgatggtcatcgaaccttccgcccacaactgcaagaagcgttcgatccgggcagaagtgtggtcgggtccctgcccctcgtgcccgtgcggtaacagcagcacgacgttggacaattggccccacttggcctcaccggagctgatgaactcgtcgatgatcgactgcgcgccgttgacgaagtcgccgaactgcgcctcccagagcaccacggcgtccggattgcccacagtgtagccgtactcgaagccgacggcggcgtactccgacagtggcgagtcgtagaccaggaactttccgccggtcgggctgccgtcggagttggtcgccagcagctgcagtggtgtgaactcctcgccagtgtggcggtcgatgagaaccgaatgccgctgggagaaggtgccgcggcggctgtcctgccccgacaagcgcaccagcttgccttcggccaccagcgagcccagcgccagcagctcgccaaaggcccagtcgatcttgccttcataggccatctcccggcgcttctccagcaccggttggactcgcgggtgcgcggtgaagccgttcggcaaggcgaggaacgcatcgccgatccgggccagcagcgacttgtccaccgcagtggccagccccgcgggaatcatctggtcggactcgaccgactcgctcggctgcacaccgtgcttctccagctcgcgcacttcgttgaacacccgttccagctggccctggtagtcgcgcagcgcgtcctcggcctccttcatcgagatgtcgccacgtccgatcagggcttcggtgtagcttttgcgggccccgcgcttggtgtcgacgacgtcgtacacgtaggggttggtcatcgacgggtcgtcaccctcgttgtgcccgcggcggcggtagcacagcatgtcgatgacgacgtccttcttgaaccgttgtcggaagtccaccgccaaccgcgccacccagacacacgcctccgggtcgtcgccgttgacgtgaaagatcggtgccccgatcatctttgcgacgtcggtgcagtactcgctggacctggaatactcgggcgcggtggtgaagccgatctggttgttgacgatgatgtggatggtgccgccgacgcggtagcccggcagattcgccaggttcagcgtctcggcgaccacaccctgaccggcgaacgcggcatcgccatgcaacatcagcggcaccaccgagaacgcccgttggccgtcgctgtcgatgcttccgtggtcgagcagatcctgcttggcccgcaccaatccctccagcaccgggtcgacggcctccagatgcgacgggttggcggtcagcgacacctgaatgtcgttgtcgccgaacatctgcaggtacagcccggtggcgcccaggtggtacttgacgtcaccggagccgtgcgcctgcgacggattcaggttgccctcgaactcggtgaagatctgcgagtacggcttgccgacgatgttggccagcacgttgagccggccccggtgcggcatcccgatgaccacctcgtcgaggccgtgctcagcgcactggtcgatcgccgcgtccatcatcgggatcacgctttcggcgccttccagcgagaaccgcttctggccgacgtacttggtctgtaggaacgtttcaaaggcctcggcggcgttgagcttgctgaggatgtatttctgttgggccacagtgggtttgacgtgcttggtctcgacccgttgttcgagccactccttttgttcggggtcgaggatatgggcgtactccacgccgatgtggcggcagtaggcatcgcgcagcaagcccagcacgtcgcgcagtttcttgtactgcgcaccggcaaagccgtcgaccttgaacacccgatcgagatcccacagcgtcaggccgtgggtcagcacttcgaggtcggggtgactgcggaaccgagctttgtccaaccgcagcgggtcggtatcggccatcagatggccgcggttgcggtaggccgcgatcaagttcatgacgcgagcgttcttgtcgacgatcgagtcggggttgtcggtgctccagcgcaccggcagatatgggatgctcagttcgcggaagacctcgtcccagaagccatccgagagcagcaactcgtggatggtgcgcaggaagtcgcccgattccgcgccctggatgatgcggtggtcgtaggtggaggtcaaagtgatcaatttgccgatgcccagctcggcgatgcgttcctcgctggcgccttgaaactcggcggggtattccatggcgcccacgccgatgatggcgccctggccgggcatcagccgcggcaccgaatgcacggtgccgatggttccgggattggtcagcgaaatcgtcacgccggcaaagtcttcagtggtcagcttgccgtcgcgggcccggcgtacgatgtcttcgtaggccgtgacgaactgcgcgaatcgcatggtctcgcaccgcttgatgccggccaccaccagggaacgcttcccgtccttgccttgcaggtcgatcgccaggccgagattggtgtgcgccggcgtgaccgcggtgggcttgccgtcgacttcggtgtagtgccggttcatgttcgggaatttcttcaccgcctgcaccagggcgtagcccagcaaatgcgtgaacgagatcttgccgccgcgggtccgcttcaactggttgttgatgacgatccggttgtcgatcagtagcttggccgggaccgcccggacgctggtcgccgtcggcacctccaacgacgcggacatgttcttgacgacggccgcggcggcgccgcgcagcaccgctacctcgtcaccttcggctggcgggggaacggcagttttggcggccagtgcggcgaccacgccgttgcccgcggccgcggtgtcggccggcttggggggtgcctgcggggcggccgcagcggcccgctcggcaacgagtggcgaggtaacccgggttggttcggcagctggttgggaggtgggttcggggctgtagtcaaccaggaactcgtgccagctgggatcgaccgaggaggggtcgtcgcggaacttgcggtacatctcttcgaccagccattcgttttgcccgaatggtgaacttatgttggccacggccgctgttcgcctcgattcttctgctagttgaagtcctgcaagcgcattgcgcggcgcctgctggcagtcggtgaacggtctgccccataaaggctaacgctttgccagcgattcgccagagagaccgggcaacgcgcgctagctggcatcccgaacggtcggtagcacgtgcagggtgaccggccagcgcgccggcggggtgccgaatgccgatcgcgcattacggacgagcttcttgccgaccagccgattgccgatggcgccgatgatcgcgccgatacccatcggcaccagcttgccaaacatgagcgcgccgcgtttcagcgcgaatcgtttgacgacgtatttgagcattcgcgagttcaacgacgatatcgccggcagcggcagcgaggccatggtctccgacacccagccgccgctggttcggcccggaccgagcagatcggccaccgcagtagtgttgtcgccgaccagcaccgccaagaccagggcacggcgccgttctcggtggtcgaggggaatggcgtgtaccgaggccagcgccagcacgaacagcgcggtggcctcaaggaacacgacaacctctccggccgcggcgaaccatgcggccagggtgccgatccccggtaaggtcgcggccgcacctaccgccgctccactggccgtcaccaccgacaagaagcgtttctcgagcttggctacgatcttggcggggctggcccccgggtgggcgcgacgcaggcgggccacatacgcctgtgctgccgggccctgtatccgcgaactccgttcgatgacctgcgccaatgcccgcgtggacactttgggccgcccgccggtcccggccagctgcgggtccggctcagctgcatttgcggatcgattgtcgaaccttttccaagacctgattcgtcgagcgctcatcttctctcctgcgaatggcgtcccctcaggctaatgccggttcaacgatccgagcatgtgtttcggtagcggcgcggttcaccgctcgaagcggaataatgcggcgtggacattggtgacgatacgggttgccctggtgcatgccgtgacgcccgtgacccaatgccaccgctagcaagccaaacgaggtgcgtgtatgactacggcgatacgccgggcggccgggagcagctacttccgaaacccctggcctgcgctgtgggcgatgatggttggcttcttcatgatcatgctcgactccaccgtcgtagccatcgcgaatccgaccatcatggcccagctacgcatcggttacgccaccgtggtttgggtgaccagcgcctatctgctggcctacgcggtgccaatgctggtggccggccggcttggcgaccggttcggcccgaagaatctctacctgattggcctgggggtattcaccgttgcgtcgctggggtgcggtctgtcgagcggtgccggcatgctgattgccgctcgagtggtgcaaggcgtcggcgccggattgcttaccccgcagacgctgtcgacgataacgcggatcttcccggctcatcgccgcggtgtcgcgctgggcgcatggggcaccgtcgccagtgtcgccagcctggtgggaccgttggccggcggcgcgctggtcgacagcatggggtgggagtggattttcttcgtcaacgttcccgtcggcgtcatcggcctgatcctggcggcctatctgattccggcactaccccaccacccgcatcggttcgattggttcggcgtcggattgtctggtgcgggaatgtttctgattgtcttcggactacagcagggccagtccgccaattggcagccttggatttgggcggtgatcgtcggcggtatcgggtttatgtcgctgttcgtttactggcaggcgcggaacgcccgcgagccgctgatcccactggaggtcttcaacgaccggaacttcagcttgtccaacctcaggatagcgatcatcgccttcgcggggacggggatgatgctgccggtgacgttttatgcgcaggcggtgtgtgggttgtcgccgacccacacggccgtgctgttcgcgccgacggcgatcgtcggtggcgtgctggccccgttcgtcggcatgatcattgacaggtcccatccgttgtgcgtactgggtttcggcttctcggtgctggcgatcgcaatgacatggctcttatgcgagatggctccgggcacgcccatctggcggctggtgttgccgttcatcgcgttaggcgttgctggggcgttcgtgtggtcgccgctgaccgtcaccgcgacccgcaatctacggccgcacctggccggtgcgagctcaggtgtgttcaacgccgtccggcagctgggggctgtgctggggagcgcgagcatggccgcgttcatgacgtcgcgcatcgccgccgagatgcccggtggtgtggacgcccttaccggtcccgccgggcaggacgctaccgtgttgcagctgcccgagttcgtgcgcgaacccttcgcggccgcgatgtcgcaatcgatgctgttgcccgccttcgtcgccctattcgggatcgttgccgcgttgttcctggttgacttcaccggtgctgcggttgccaaagagccgttgcccgaatccgatggcgacgctgacgacgacgactatgtcgagtacatccttcgtcgggaaccggaagaggattgcgacacccagccgctgcgggcgtcgcgcccggcagcggccgcagcgtcacgcagcggtgctgggggtccgctggcggtcagctggtcgacgtcagcccaaggaatgcccccaggtccaccaggccgtcgggcgtggcaggcagatactgagtcaacagctccgagcgcactataaccgcggcatactgtgcccgactgaccgcgacgttgagccgattccggttgagcaggaacgagattccgcgtggaacatcgtcggcggacgaggccgtcatcgagatgaagaccaccggtgcctgcccgccctggaatttgtcgacggtgcctacccgtactccgtcagccccgccaagtccggcagacgccaaccgccgacggaccagcgccacctgggcgttgtacggcgcgagcacaagcacatcggaagcggccagtggccgggtgccgtgctcgtcggtccacggcgagccgagcagctgccgcagctcggcgaggatcgcctcggcctcttcggggctttcgatcgaattgcccttgtggtgcacgccacgcgtatgcacccccgggggatacccgtcgaggcggcgcacggcggtgcgctcggtgtgggaacacagcctgccctcgtaggacaacgccgacacggccgcgcacaccgccgggtgcatccggtacgagcggtctaagaagtagccgcgttcgtcgggcagcgtgtgttgcccatctaccagccacgacaatgcggaggtgtcgacgggttcgggatgtgtgccctgacttacctgaggcagttgctgtggatcgccaagcagcaacaggtttgtggccgcgggcgccacggcgatggtattggccaggcagaactggccagcctcgtcgatcaccagcagatccaggctggctttcggcacccgattgccgttggcgaagtcccacgccgtgccgccgatcacgcatccggcggtgtcgcggatgaattctgtgtactggctcccgtcgatcgactgccagcgcccagcggtgtggtcgtgcggctttttggcgacctgccccgggtccaggccagcgctgatcacaccttccaacaggttctccaccgtggcgtgcgactgggcgacaacgccaatacgccaggcatgctcggtgaccaactccgcgatcacccgggccgcggtgtatgtcttgccggtccccggagggccgtgcaccgccaggtatgacgagtccaagtccagcgccgccgcggcgatatcggtgactgggtcactgctgcggggcaatgcggcgccgctgcgcgtgcgaggagggcgacgcagcagcacgtccattagcgcggtgctgggcagttgcggcgatccggaagccacggcagcggccgtcgattcgatcgattcccgcagggccgtcgtcggcaccggcggcccgggagcgagcgcgaacgggagctgctgaaatgtattgccgtcactgccggttcgttcgacgatgaccacctcggtgggcacagtggggtcgtcggtctcaaccactgcggcggggcccgcggctcggcgatcaggattgtcggtcatgcccggcggcgccgggggttcgtagagggcaaacacattcccgttgaggtccccacgtgccagttcaccggtaagccggacccgccgctgcggcttgcgcgcgcgaggcggcatatgccagtcgacggtgaccgaagcctcgctggcaaggaagacgtccgtgctgtccgaccattcgtcgacggggtagttgagccggtcgaagtgcgcccaccagaacggcttgtcctcgcggcgatgatagccgcgggcagcggccagcaaggcgaccgctgtctgttccggcgtgcgctcgccggcggcggcatcgccggtgaacttggacagtaccgacgccagcgagtcaccgtcgtcgatagggtcggcgtccggaactggttgagcgccaatgggtgtgacgccggcttcccaggcgcgcatgagcagccagtcacgcagcgcgcgggtggaccggcagtcgtagtggttgtagccttcgatctctttgagcacggttgccgcctcatcgatgcggccggccgcgcgcagttcgcagtaccgggcataggagttgatcgagtcggcggcggtggtgacgtcgccggagcgtggctgcgtcccgaggtacagcggctccagcgccttcaagctgaacgagtcggtgcccacccgaatgctcttgcgtaccaacgggtataagtccaccaggactccgttgcgcagcaagtcgtcgacgtcgtcctcgccgatgccgtagcgtccgaccagccgcagcagcgcggtcttctcgtagggcgcgtagtggtagatgtgcatgttggggtggcgccggcgccgtctggcgactatcgccaggaaatcggtcagcgcctggcgttcggctgtccggtcatgcgcccacaatggtcggaatactcccgcccgtccggcttccagcaccccgaacaggtattccaggccccactgtttgccgtcggcggtccacagcgggtcaccctcgaagtcgaagaacaggtcgccggggtttggctccggcagcagtgtcagcggccgcgggtcgacgatctcgaactgtggtgctcccgtatcgcgttggcggatttgcagtttggcctgtgcggtcagcttgcccagcgcgttcgtggtcaggccgggaaccggcgcggtgtgatctgccagttcggcgatcgtggtgatgccggcctcaaggagcttgtcgcgctggcggactcgcatccctccgaccagtagcagatcgtcgctggcgcgcagccgctcggtgcactgcggacagcggaagcacgcctgcacgcgttcgtcgtcccagcgcaccgcggtgcccgcggtgtagtggccgtccagcaatcgctgtaaaagcgcacgctgggaccggtagaccgggatgagctcgccgacgcggtagcgcacgatcgtgccgtcgccgagttcgagctcggcgtcggcagccaccggaacgcccgagtgaaccagcgcatcggcataggccgccagctgtagcagcgcggtcacggttggcgagcgggcgagcttggtgtcggcgacccggtaccggtgaccgtcgcggatcaggaagtcggcgaacccgacgaagcggccgtcgaacatggcggcctgatacaccaccggggcgtggttggcgatggcacgtcgcgtcgcgtcggcggctgccgccagcccggcgggcgtgtaggccggccggccaatgatagccaccgcgtcgccgaactcgtggcgcagttggtcgagtcggcgtccttcatgcgcgctaccgagaacggcggctcgcgccatcagttcgtcgtcaactgcgacggccggtccccggcctagtttcgcgtcgaattcacggagcagtgcgtactggcaccgggcggcggctgcgagatccgaagcactgtagacgatgctgtcaccggtgacgaacacagcagcaactcctcggtgagacaacggacaggcaaactgggctgcacccgtcggcttaaccgccggtggtgttgccgatcagctcgacgccgccgccgttccagcggaacttgacaacgttgttcaacccgatgccgctggcatacgtcaatgccaccgtgtctcccgtgcactgcgaggtgtcgatgccggtgaacccataggtatcgggcaccccctgcggtatgtacttgccgaggtggaacatcaccgcgcgggtggtcggattgccggcgttcgtgttggccttgatgaccaccgccgacagctgggcacactcgttgtagttgccggccagcggttctgggttccagggctgctcactgcgcggatcgcgaggaagttcggagacgactttggcgattgtgggcgaggcgaggttcaccgcacacgggtcgaccggcgcggcgctgtggttgctgggtggggcagctgtcgcggacggcgggctcggttcgctgctcggcggggccgggtgagcagttgacagggatggggtggcctccggcgtcttagcgaccgtggagtcgcccgaaccgcaaccggtcaacgtcgcggcgaccaatgcagcgaccacgccaacacgcggcgtggtggggcagggtggtgaccacacaccgggcaccgtaccgccatcgggcccgcgggtgcggtaggcgtggccgggtcaccactaaacttgacggcctgatggccttcccggaatattcgcctgcggcgtccgctgcgacgtttgctgacctgcagattcatccccgcgtcttgcgggcgatcggcgacgtcggttacgagtcaccgacggctatccaggcggctacgatcccggcgttgatggcaggctccgacgtggtggggctggcgcagaccggcaccggcaagacggcggcatttgcgattccgatgctgtccaagatcgacatcaccagcaaggtgccccaggcgctggtgctggtgcccacccgggagctggctctgcaggtggccgaggcgttcggccgctacggtgcctatctgtcgcaactcaacgtgctgccgatctacggcggatcgtcgtatgccgtgcaactggccggattgagacgcggcgcgcaggtggtggttggcacccccggtcgtatgatagaccatctcgaacgggcgaccttggacctgtcgcgggtggactttctagtgctcgatgaggccgatgagatgctgaccatgggtttcgccgacgacgttgagcgcattctgtccgagacccccgaatacaagcaggtcgccctgttttccgcgaccatgccgccggcgatccgcaaactcagcgccaagtatctgcacgatccgttcgaagtcacttgtaaggcgaaaaccgctgtggccgagaatatttcgcagagctacattcaggtagcacggaagatggacgcgctcaccagagtgctcgaagtcgagccgttcgaggcgatgatcgtctttgtccgcaccaagcaggcgaccgaggagattgccgaaaagctgcgtgcccgagggttttccgcggctgccatcagcggtgacgtcccgcaggcgcagcgggagcggaccatcacggcgctgcgggacggcgacatcgatatcctggtcgccaccgatgtggcggcgcgcggactcgacgtggagcggatatcacacgtgcttaactacgacatcccgcacgacaccgagtcctacgtacaccggatcgggcgcaccggcagggccgggcgttcgggagccgcgctgatattcgtctcgccacgggagcttcacctgctcaaggcgatcgaaaaggctacgcggcaaacgcttaccgaggcgcaattgcccaccgtcgaggatgtcaacacccagcgggtggccaagttcgccgattccatcaccaatgcgctgggcggtccgggaatcgagctgttccgccgactggtcgaggagtatgaacgcgagcatgatgtcccgatggctgacatcgccgcggcactggccgtgcagtgccgcggcggtgaggcattcctgatggcacccgacccgccgctttcgcggcgcaaccgcgaccagcgtcgggaccgtccgcaaaggcccaagcgtagaccggacttgaccacctaccgcgtcgccgtcggcaagcggcacaagatcggtccaggcgccatcgtcggcgccatcgccaatgagggtgggctgcaccgcagcgacttcggtcagatccgtatcgggccagacttctcgctagtagaattgccggcgaagctgccccgcgcgacgctcaaaaagcttgcacagacccgtatctcgggtgtgctgatcgaccttcggccataccggccgcccgacgcggcgcgccggcataatggcggcaaaccacggcggaaacacgtcggatgaccctgcccaaggaaagagccgcccagggcggactcgagcggatcgcccacgtggaccgggtggcgtcgttgaccgggatccgtgctgttgccgcattgctggtcgtcggcactcatgcggcctacaccaccggcaagtacacccacggctattggggcctgatgtcgtcccgcatggagatcggcgttccgatctttttcgtgctgtcggggttcctgctattccggccatgggttaagtccgccgctaccggcggccccccgccgtcgttgagccgctatgcgtggcaccgggtccggcggatcatgcccgcctacaccgtcaccgttctgttggcctacctcgtctatcacttccgcacggcggggcccaaccccgggcacacctgggtcgggctgttccgcaacctcaccttgacgcagatctataccgacggctatctgggtgcgttcctgcatcagggtctgacccaaatgtggagcctcgcggtggaggttgccttctacctggcgttgccggcgttggcatacctactgttggtgctcgtctgccggcggcgatggcagcccaggttgctgttggccaccatggcggggctgacgatgatcagcccggcatggttgatcctggtgcacaacacgcactggatgcccgacggcgctcggctgtggctacccacctatctggcttggttcgtcggcggcatgatgctggccgtgctggcggcgatgggcgtgcgctgttatgcattcgtggccataccgttggcggtcatctgctacttcatcgtctccactccgatcgcgggcgcgcccacgacgtcgcccacagcgctggccgaggcgctggtcaagaccgccttctatgccgtgatcgccgtgctggcggtggcaccgctggccttgggtgaccaggggtggtatgcccagttgctggccagccggccgatggtgtttcttggtgagatctcctacgagatcttcctgatccatctggtgaccatggagatcgccatggtggacgtgctcgggtatcgggtttacaccagttcgatggtgaacctttgtctcgtgacgctggtgctgacgatcccattggcgtggttgttgcaccgtttcactcgggtccagggtgaccggccttcctagcggcggcagaagcaggtgtcacgatcgggacgacgaactccgcgatcatcgctcgttcgtcggcttcgtcacggccggggaacatcagcagcgatgtgagcatccggaccacccagcgggcgcggcgttcgacggtggtcggatcgtcgggacctagtgagttgaggaatgccgcggccagggccgcgatcacctcggaccgtccggccatctcgccgccgatcggtgggcgggtggtggtaaaccacgcggccaacgcggggttgtcgcggaccatccgcaacgtcgtggtgatgctcaccagcagccgttcggcaggttcgacgacatcggcgatcttcaccatgatctcgcggccgagccggcgggtctcgcggtgcacgtacgcggttcgcagcgcctcgcggctgtcgaagtaccgatacagtgttgcgcgcgaacagcctgcggccttggcgatctcgttcatgccgatcgacgccgggtcacgctgcgtaaagagtcgctcggcggcgtcgagtatccgatctgcggctaactcggtccgacgcgcggacagccagtcggtacccgccatcaggatgtcactcggaacggcaccgacagcggacgccggacataactgccgccggaccacacgatgcgtgactcggccacctcgaagtccgggcaccgggccagcagttcggtcagcgccacccggcattgcatccgggccgcggccgcacccaggcagtggtgggcgccgtggctgaaggtcaagatgttgcgcgggcaccgagtgacatcgagttcggctgcgtccgggccgtattggcgttcgtcacggttggccgagccgtacagcagcagcacccggcgaccggccgggatggtggtgtcaccgatcgtgacgtcgcgcgtggttgtgcgcgccagcccctgcaccggcgaggtgagccgcagcagctcctcgaccgcgtcggggatgccctctgggtcatccagcagcagccggcgctggtcgggccgccggtgcagcaacggcatcgaaccgcctagcatgccggtgacggtgtcgttgccgccggtgaccatggtgaacgtgaacgccagtatggacagtgtgccggcggtgtcgccgtcggcgccgaccccggcggctaccaggtgggagatggcgtcgtcggcgggctcggtgcggcgtcgctcgatcagcccggtgaagtaggccatcatcgagccgaccgcgtccagtgcgccggtggtggcgccgtcaaccgcgttcgccgccacgatggcctgggtccacccgtcgaattgcgtccaatcctcttcgggaacaccgagatagtgcgccaccaccatcgacgggagcggtttgaatagttcggtgacaatgtcgccgccaccgttggcgcgcagcttttcgagccgctcaacgacgaacttgcgcaccgtgggctcgacggtttcgacctgtcgtggcgtgaagccgcgcgacaccagcttgcgaaactcggtgtggaccggcggatcctgcatcaccatgggcggggtgtcgtgcagtccaatcatttccagctcgccgtagttaacggtcaagccttgcgccgacgagaacgtctgatggtcccgcgctgccgaccagacgtcggcgtgccgggacagcacgtagtagtcgtactcgggacgctgcggcgggacgacgtggtgcaccgggtcgtggtcgcgcaacgcgcggtacatcggccacggattcggccaggtttcggcggtggcgagctggaattcgtgagacattactgatgtcatgtcttatgtctaagacattccatcggtaatatcaatcggcgattgtgaatctggtgacgcgacacgccgaggacgcgtcgtgcggttcacactcggcgggacgtcgcgacggatcagatcgccgagccgggattgaggatgccctgggggtccagcgcttgcttgatgcgctggttgagggccaggacgtcgggcccgagatagccggccaaccacggccgtttcaaccggcccacgccgtgttcgccggtgatcgtgccgcccaggccgacggccaggtccatgatttcgccgtacgcgaggtgggcgcgctctagcatcgcggcatctgcggggtcgtacaccagcaacgggtgggtattgccgtccccggcgtgggcgatcaccgagatcatcagattccgctcctcggcgatgcgcgcaatcccggtgaccagttcgcccagtgcgggcagcggtaccccgacgtcctcgagcagcaacgcccccttgctctcgaccgccggaatggcgaaccgccgggccgcaatgaacgcctcgccctcatccgggtcgtcggtcgaaaacacgtctatcgcaccgttttcggcgaacacggcggccatcacggcggcgtcttcggtggccgcgcggccacgttcatcagaaccagccaccagcatggccgccgcatcgcggtccaggtccatccgcaaggtgtcctcgacggcgttgatcgccaccgaatccatgaactccagcatcgcggggcgaagtcggccggtaaccccgagcaccgcatcgaccgccgcctgcaccgagccgaagctggccaccacgatgctcgatgcattctgtgcgggcagcagtcgcaacgtcacctccgtgatgacgcccagcgtgccttcgctgccgacgaacagtttggtcagggaaagcccggcgacgtccttgagccgtgggccgcccagccggaccgcggtgccgttggccagcacaacctgcatgcccagtacgtagtcgcctgtgacgccgtacttcacgcagcacagcccgccggcgttggtggcgatgttgccgccgatgctgcagatctcgaacgacgacggatccgggggataccacaggccgtgttcggcggcggcctccttcacctcggcgttgtacaggccgggctggcacactgcggtgcgggtgaccgggtcgacggtgatgtcgcgcatcttttcggtggacagcacgatcccgccatccagggcggtcgccccgcccgaaaggccgctaccggctcctcgggtcaccacgggcacctggttcgcactggcccaacgcagcaccgtctgcacctcttcggtgcgccgtggccggatgattgccagcggtttgccggccgaagggtcaaaggcccggtcttgccggtagccgtcggtgacggcggggtcggtgaccaccatcccctcgggcagctcggccatcaggccagccagcacatcggtattcactgagccgatcctacgggccgatcgatgtccgcttggggcgccagatccagttcgcgcagcgcgggcagccggatcgcgaccagcccggtgcacacgatgggcagtgccaacgcgagaaacgtggcatgcagtccagcggcgtcggtcagtggaccggccagcaacagacccaacgggccggcggcgtaggccagcgacgtcatcaccccgactacccggccgcgcagatgctgtgctgcccgcgtctgtatcacgtagttatagatcggctggatgggtccgtacaccaggccgaccaccgcgcacaacaccatgatgaccggcagtggcggcaggaacgcgatgaccatcgatgccaaacccagggtaagaaccgcggtcgacatggtcacgcgacggggaacgcggatagccaacacggcataccccagcgctcccaccaggccgccgccggcgatcgccatcaacgcccaacccagctgcaccggttgctggtggtcggtgaagtatttcgggaacagcacgctctccatcggcagatacagcgcggtgacggtcaggtcaatcatcccgagggtgcgcaatacccgcaggttccagacgaagcgcagcccctcggcgatcccggataccaacccttggggccgcgaggtgtggtgcggcttgccggcaccctcgagttgcagggcggcaatcgcgaggatggacaacccgaatgccgtcgcggtaatccacattgtggtgatgccgccaaccgtcgcgatcatcaagccaccgatggccgggccgacaataaaggccaggttgaggatcgcctcgtaggcgccgttgatgcggtccaacgaccagcctgcccgagcggcggcctcgggcagcatcgagtcacgagccgtcatgcctgccgggccgaaggcggccgccagggcggccaatacggccagcaccagcacgttgaccgcgtcgccgccgtacccccacgccaccagggggacgccggccaccgccgcacccgacagcgcatcggccaccatcgacacccggcgacgcccgaagtagtcgaccgcggtgccggcgaccagcgtggcgaacaacagcggcagcatggtcgcactggccacgatcgaggcctgcccagcgctgccctcgcgctgcaacaccagccacggaaacgcgactatcgagacgccatcacccgcggccgccatcagcgttgcgaacaggatcaggaatgccgggccgcggttgctgtttctcatgaatatcgcggctgaatctagcgccaaaccggtatgggggccaccgaatttctgcgctgccgcagcccggatgcaggatgttcgtgtgctcatgcatccgaagaccggccgggcgttcaggtccccggtagagcccggttccggctggccaggtgatccggcgacaccgcagaccccggtggctgccgatgccgcgcaggtgtcagcgctggccgggggcgctggctcgatctgcgaactcaacgcgctgatcagcgtgtgccgggcgtgtccccggctggtcagttggcgtgaggaggtcgccgtcgtcaagcgccgtgccttcgccgaccagccctactgggggcgcccggtgccggggtgggggtcgaagcggccgcggttgctgatcctcgggctggcgcccgccgcgcacggggccaaccggaccggacgaatgttcaccggcgatcggtcgggagatcagctttatgcagcactgcatagggccggcctggtgaactcaccggtcagcgtcgacgccgcggacgggctgcgggccaaccggattcggatcaccgcaccggtgcggtgtgcgcccccgggcaactcgccgacaccggccgagcggctgacatgctcaccctggctaaatgcggaatggcggctggtgtccgatcacatccgtgcgatcgtcgccctcggcgggttcgcctggcaggtcgcgttgcgcctggcgggcgcgtcggggacacccaagccgcggttcggccacggcgtcgttaccgagctgggagccggtgtgcggctactgggctgctaccacccgagccagcagaatatgttcaccggtaggttgactcctacgatgctcgacgacattttccgtgaggccaagaagctggccgggattgagtgacgtgaagacggttgtggtttccggcgccagtgtggccggtacggcggcggcgtactggcttgggcggcacggctattcggtaacgatggtggagcgccatcccgggctgcgaccaggggggcaggctattgatgtccgaggtccggcgctggatgtgttggaacgtatggggttactggcagccgcccaggaacacaagacgaggattcggggcgcctccttcgtcgatcgtgacggcaatgagctgttccgggacaccgaatcgacgcccaccggcggtccagtcaacagtcccgatatcgagctgctacgtgacgatcttgtcgaattgctctacggggcaactcaacccagcgttgaatacctgttcgacgacagcatttccacattgcaggacgacggcgactcggtgcgggtgacctttgagcgcgcggcggcccgcgagttcgacctcgttatcggtgccgacggactgcattccaacgtgcgcaggttggttttcggtccggaggagcagtttgtcaagcgattaggaactcacgcggcgatttttaccgtgcccaacttcctggagttggactactggcagacctggcattacggtgactccaccatggctggcgtttacagtgcgcgcaacaacaccgaagcccgcgctgcactagccttcatggacaccgaactgcggatcgactaccgcgacaccgaagctcagttcgccgaactgcaacgtcggatggccgaggacggctgggtgcgcgcgcaactgctgcactacatgcgcagcgcaccggatttctatttcgacgaaatgtcgcagatcctgatggatcgctggtcgcggggcagggtagcgctcgttggcgacgctggttattgctgctcgcccttgtcggggcaggggaccagcgtcgccctgctgggtgcctacatcctggccggcgaactcaaggcggccggtgacgactaccaactcggattcgccaattaccacgccgaatttcacggctttgtcgagcgcaaccaatggttggtcagcgacaacatccccggtggtgcgccgataccgcaggaggagttcgaacgaatcgtgcattccatcacgatcaaggactactgagcgccttcacccgggcgcagccaggatggcgctcgtcggccgcttcaccgaacctgaagatctgcagacgaagtacgagtaggggccggcaaatttaccggctcgacgcgcagaagcgccgagatttagcggcgggtcaatacgacgaccgggattggccgtgacgtccggctctggtagttggtgtatcggttggcgttgttctcgttgacgatctgccagagccgcgcgtagtccgggtcgtggggctgcaccggtttcgctgtcacaccgaatcgcttgggcccgacgttgatttcgacgtccgggttggccttgaggttgtggtaccaacccggcgagcggggatcgccacctttggacgccacgatcaggtacgcgtcgccgtcgcgagcataggtgagtgacgtggttcgcggctggctcgtcttggcgccggtggtatgcagcagcaaactcggtggcgcgccggggattcggtgtccgatccgaccgttagtgcctcggtagatcgcgtcgtgcagcctgagcagctgcacgcctacgtggcgctcaagccatcgggaaatgtccatggggtcagtcttgcgcagcggcatcctgttgcgccagcgcctcccgcaggatccgtccggtggcttcccggtccgggtcgcggcgcagcatcattcccttggcgaccgacagcttgtcgccgttgcgcggcggtaatacgtgcaagtgaacgtggaacaccgtctgaaaagcggcacggccgtcgttgatggcgatgtgtgtcgcgtcagccaacttcgtggcgcgggccgcccgcgcgatgcgttggccgatggcgaccatgtcagccaacgcctccggcggggtgtcggtgaggtcaacggtgtgtcgcttgggcagcaccagcgtgtggccgcgggtgaacgggcggatgtcgaggatcgcgagatagccgccgtcctcgtagatccggatggccggagcctccccggcgatgatcgcacagaacacgcagggcatgtcgctacggtactggacctctcggagaccgcccaagtgaacgggatacgctgccgccgtggaccctactgacctggccttcgccggtgccgcggcacaggcgcggatgctggctgacggtgcactcaccgcgccgatgctgctcgaggtctacctgcaacgaattgagcgtctggacagccacctgcgcgcctaccgggtggtgcagttcgaccgggcgcgtgcggaggccgaggccgcccagcaacgcctcgacgccggtgagcggctgccgctcctgggcgtgccgatcgccatcaaagatgatgtcgacatcgccggggaggtgacgacatacggcagcgccgggcacggtccggccgcgacgtccgacgcagaggtggttcgccggctgcgcgcggcaggcgctgtcatcatcggcaaaaccaacgtgcctgagttgatgatcatgcccttcaccgagtcgctggccttcggggccacccggaatccgtggtgcctcaatcgaacccctggcggcagcagcggcggcagcgctgcggcggtagcggccgggctggcgccagtggcactgggatccgatggtggcggatcgattcgtatcccgtgtacctggtgcggtctgtttgggctgaaaccacagcgcgatcggatttccttggagccgcacgacggggcctggcaggggctgagcgtcaatggcccgatcgcgcggtcggtaatggacgcggcgttgctactggacgcgaccacaacggtgcctggtcccgaaggcgagtttgtggccgcggccgcacgccaacccggccggctgcgaattgccttgagcaccagggttccaaccccgctgcccgttaggtgcggcaagcaagaactggcagccgtccaccaggcaggtgcgttgctacgtgatctgggccacgacgtcgtcgtccgcgatcccgactatccggcttcgacctatgccaactacctgccccgctttttccgcggtatcagcgacgacgcggacgcgcaggcgcacccggaccgcctcgaagcacgtacccgagccatagcgcgtctagggtcgttcttctccgaccggcggatggcggccctgcgggccgccgaggtggtgctgagcagccggatccagtcgatcttcgacgatgtcgacgtagttgtgacgccaggcgccgcgaccggcccgtcccgcatcggcgcctaccaacgccggggtgcagtttcgacgttgctgctggtggtgcagcgggttccgtactttcaagtctggaatctgaccggccagcccgcggccgtggtgccgtgggacttcgacggcgacggcctgcccatgtcggttcaactcgtcggccggccgtatgacgaggcgacgctgctggcactggccgcacagatcgaatctgccagaccctgggcccatcggcggccgtcggtgtcatgacattgcagtcgcccgctcgtttttcacgtttttgcccggccgcaggacatgtgcggcggcgttaacgttgactggtgacagaccacgtgcgcgaggcggacgacgcgaacatcgacgatctgttgggcgacctgggcggtaccgcgcgcgccgagcgtgcga

SEQ ID NO: 647 - DNA, 80557 bp, Mycobacterium tuberculosis
aagcttccacaggtagggatcgaggaacagcgcgttgaactgataggtgcggcccggctcgagcaggccggccatttgttcgatgcggttaccgaagatctcttcggtgacctgcccgccgccggccagctcggcccagtgcccggcgttggccgccgcggcgacgatcttggcgtccacggtggtcggggtcatgcccgcgagcaggatcggcgagcggccggtcagccgggtgaacttcgtcgagagcttgaccctgccgtcggggaggcgaaccacggtcggtgcgtagctcgaccaggcccgggcaacctcgggggtggcgccgacggtgaacaggttgcgctggccaccgcgggtagccgccggcacgatgccgatgcccaggccgcggatcaccggtgcggtcagtcgggtcaggatgtcgcccggccccaggtcgaggatccagcgggcgccggccgcgtggacacgggtgatctcgtcgacccagtcgacctttctgatcaagatggcatcggccagctcccgagccaaggcgacatcgaggcccgccttctcggcccagcccgcgacgatgtcgatcccgtcggatagccgcggggtgtgaaagcccacctccacctgcaccggctcgaagaccggcgagaagacgtcgccgccgcggaccttgttcttgcggtcggcttcttccttctcggagatctggcggcaataaagctcgaaacgcgacagctgctcgggggtgccggtgatgacgacggcacgccggccgttgcggatggacaacaccggtggcagcaccgtgcgcacgtcctgggcgaactcgtcgagcaaccggccgatgcgctcggggtcggcgttggtgaccgataccatcggcgggcgatcgcccaggacggaaattccgcgccggcgggccaccagcgttccggcggcaccgatcaactgggccaaggcaaacagctcgacgtcgcgtgccccaccagccttgagggcttccaccgccagcacaccttgcgaatgccccgccatggcgaccggcggggtggccacgaggtccatgccttgacgggccagcgcccgggtcgccgcgatctgggtaagcaacacgccgggcaccgacacggcggccgacgtcaggtgcttgtcggacggaaccgggtcctcggccgccagtgcgcgtacccattgcagcggctcgaaaccgatcgggcgcaccacaatcagctcgtcggtgaccggatcgagcaacagctctgcctcaccgaccaacgtcgccaactcggtttctatcccggtggccgacaccagctcttcgagggtttccagccaggcgctgccctggccaccgaatgcgacagcgtagggctcaccagccatgaggcgatcgaccagagcgtgggtggtatgcgggctgtccccgccgcgatcagcggacacccggtcgtgctcgtggatcgtcacggtctatgtctccctatgtgcatcggtacgtgtcagttcgtacagcggcccaggctgccgtgcggggcatccccgactccgcaccgactcccagccgaaatcctctgaccggtgtgttgtcggtgggccggcccgtgggtcgagcagcgcgacgggctgcatcggccttataagagtctcataaggatcggtccaccttgtttacacagatcggttactggcgagttctacgtacgggtaaccgtgtcgtgggtaacgccgggttcgacggccggcgcgtatgtgttgaccaaacgtcctgcgtgcaggtggttacggtggagtagctataactgcgctgatcaaggcagttttgttatcaaatcgttatgctgggaattcgctctacgccgggcgcgtgccgacgcgccgacccaaaggccgcgccattggcggcgttggcccggggttggcaatgccgtgcagcgggcgaacgagtgtttgctgtagtgcagcgggggccaggctcggggcggcaggctaagcccactgcccgaattggggcttcaggatttggttgacgtccaccccgaccccaccaaccttgcgcttatcgatctccacctggtgcagatgcgcggccgggtgggtgtatcccttgggcgagccccagttgtgctgccagaagtacgagcccaagccatcgttgacggcccagtcgatggttttggagttggcgtacacgccggtccgctggtgtccgatcaccgactcccaggaccgcagatatggcacgatctggttcttgtactgctcatatgatgggttgtcgtcgatcgaggcgtagatcggggcgctcgtcgggccgccggcagcggcatgcagctccgacccccgtctggcgtgctgcacgccggcgctggcaccgcccagccagtcggcagtgctccccttgccgtattgataacaggacacgatcttgagcccattgccgctcaggtcacgggcctcgctgagctggatcggcttgccaagcatccaggcgccgccaggccgccgatcggacacgtaccggattgcccccaccgcgccggcagccctgatctggctggcggggatgacaccggcggcgtagtccaacagggtgcccagcgaaccggccgatgccggcgcggcgcgcaacgacgacgcaacgacgccaagacccagcacgcccggagtcgccgccgcgaatttgagcacatcacgccgagagaccgacatatgccacagggtacgacaaaaacaacaactgtcacactggtttcagtggtcacggatgcatcacactggcagaacacatgcatgcggccataccgacaccggtgcggtctcgggcaggccgcctctccctgcgaccactactacggtgtgatcgcctacgctcccaacggcgcaatgggcaaaatcgtcgcgccaccgcactcgaggccaggcggatatcgacgcataagaactttgcggcgtcttagctgcaaagtgctcagcaacttcaccaactaccacgggggagtccgacgatcgcgcccgctggcagaacctggacgtgcaaccagttgagtagttcccacactgcgcgccgagcgtgggctggctgcgccgaatgtgcactggtggcggcgacacgcccgggcgacgccgccgtggttgcacgttcggcgtaggcagccccgtgcgcttgccgggcaggtgtcctcaaaggtccaactagacacacatatcagacactagtatgtacatatgaccgtaaagaggaccacgattgagctggacgaagatcttgtgcgggcagcccaggccgtcaccggggaaacattgcgagcgacggtcgagcgcgcgctgcagcagctggtggccgcggctgccgagcaggccgccgcgcgccggcggcggatcgtcgaccatctcgcgcacgccggcactcacgtggacgcagacgtgctgctctccgagcaggcgtggcgatgaccacctggattctggacaagagtgcccacgtgcgactcgtggccggcgccacgccgccagccggcatcgacctcaccgacctcgccatctgcgatatcggcgaacttgaatggctgtattcagcacggtcagctaccgactacgacagccaacaaacgtcactgcgcgcctatcaaatccttcgcgcacccagcgacatctttgaccgggttcgccaccttcagcgcgacctagcccaccaccgtgggatgtggcatcgaacgccgcttccggacctattcatcgccgaaaccgcgcttcatcaccgggccggcgtgttgcaccacgaccgtgactacaaacgaattgccgtcgtacggcctgggtttcaagcatgcgaactctctcgcgggcgctagcttcgcccgaatccgtgagcggaggcgataatccttacaggccatcaaaaaagtcctcgtcgagccgtaagagttcgacggtctgcaccgcctggacaccgactcgataccgcacgagcagctcggccagccgagcgccgtcgatgagttcgatccgggcgttgatccgctcagcttcctcgcgggcaccgcgggaaaacgatgacgtggtgatgtagacgccccggtcgccctgcttgcccaggagggcgccggcgaactcgtggatcttcggccggccaatcgtttggtcgacggcgtatcgcttggcctgcacgtagatgcggtccagcccgagcgggtcctggctgatgattccgtcgatgccagcgtcaccggaggcactcgtccgttccaccgcgccggctcgcccgtaacccatcgcctccaaaagtctgataaccagatcttcaaacccggtgggcgacaacgtgagtgccttcttcaggatctccccctcgacggctgcccggttctccgcaagcgcagcgtcgatgagatcctcgggtgagacctgcacatcgtccccggacggtcgcttggcggtcgcgtcgactggctgcttggctttggttcgctcacgaaaagcgatgtacgacgggaactcccgcagcacagccatgtcgacgcgctcgggatgcgccttcaggacttgacggcccgtgtccgtgacctggacgtggccccgcgtgggacggtcgagcaatccggcctgcgacatgtgagtgagagaccagtgcaccctgtcgtacatggtcctttgccgaccgctgggcaacatctgcgcccgctcgtcgtcggacagaccgaactcgtcggacatcgccgcgatgacgtccttggccgacttcgcttgtccatcggcaagatacgcgagaatcggccgcatcaacgtctgggcatcagggatcgtcatggggagccattatccagctggcttgtcagccctccgaaccggccaagttgggtaagtccatccggggctccgtgttctgacaggcccgctgcaggcgtcgcatcttcctcatctgccccacgtgtacccggtcccgccgacctaaaaggtcggcatatccctgccatgccgggacgcgtgaggcgggtgagacacaagggaacgtgcacctcgcgcaccgggtcgccagcagccgcgacacgccgtcgtccagtgccacaccgaatgcggtgtcgggctcggcgtcaaacgctgccgatcggccttgcctcgtcaggccgccgacagcaccgccctgggctcacggtccgcggctccgccgggatccgaccggcggcggctcaaccccctcgatcgtcttgagccggtcgacagaccgatcgaaagacggccaccggatcgtcccggcaggggcgaggaagtccggcgtccgagcaagcaccgggcgattgccctcaacgcggaagacaacccgatcacccgattgcaggccgagcgcgtcgcgcaccgctttcggaaccgtcacctgccccttcgacgtgacgatgggttcgtcggagtgcctgcttcaccgttgccgtacgccgcccgtaccctcacactctgtggagctgctcgtcgccgccaaccccgctgaagactcgcgcctgccctacctgatccggctgccggtgggcgcgggactggtcttcgccacctcagacgtgtggccgcgcaccaaggcgctgtattgccatcgcctcgacatcgccgactggcccgccgaccccgtcgtcgtcgaccgggtcgagctacgcagctgcagccgccggggcgcggccatcgacgtcgtcgccgcccgcgcgcgggagaaccgatcgcaactggtgcacaccatggcgcgcggccgccaggtggtgttctggcagagccccaaaacgcgcaaacagtcgcggccgggcgtgcgcacccccaccgcccgcgccgccggcatccccgagctgcacatcgtcgtcgacgcccacgaacgctacccctacacctttgccgacaaacccgcgaagacgacgcgggaagccctgccctgcggcgactacggcctgaaagtggccggccaactcgtggcggccgtcgagcgtaaagcgttggcggaccttacttctggcgtgctgaacggcaacctgaaataccaactgaccgaactggccgcgctgccacgggccgccgtggtggtcgaggaccgctactcggagatcttcgcgcactccttcgcccgcccgacggcgatcgccgatgggctggccgaattgcagatcggctttcccaacgtgccgatcgtgttctgccaaacccgcaagctcgcccaggaatacacctaccgctatctagccgccgccctcacctggttcgtcgacgatgccgacgccaccacggttttcgagccggctgccgccgagcccgagcccagcagcgccgagctgcgcgcgtgggccaaaagcgtcggcctgccggtgtccgaccgggggcgcctgcgcccgcagatcctgcaggcctggcgagccgcccatccccggtgactacaacacctcgacgaggcctgcggatgctgaatcggccagtgcggcatcgaatgtgaccaaccggcccccgtagcgcgcggccaaggcgatgagatggcagtcggtgacccgacggtggttggacaccgcatcgcgatcgccggcgctcccaacgatcagtggcacatcgtcaggccaaaacgtgtgcccggcaagagaagtcatcgccgccaactgagcgatcgcgatagccggcgtggtcgacacctgcatcacactgcgattgcttgaaattcggacataccctgcctcggtgatcggcgtggtggcccacccattcgaggagaactgcgtgaaccatcgctgcgcggccgcatggtgaacgtgattcggccagcccagcgcgatcagcacattgacatcgagcagtgccgtcacacgtcgtcctcgagcgcgcggacgacatcctcggaagtcaccgtcggcgcatccggcggaacatcaaaaaccggaaatccgtcaacctcgacaatcccaaccggacggagcgacctacgcgccaactcagaaattaccgcgccgactgacttgccctccgaccgcgcgatgctacgagcatcttctagaacatcatcatcaatctgcaacgtggtgcgcatagcatcatgttacggggcttgggccagctttcacgcgtcttcggcgaccccctgcagcacactgtcgccgttgacggtgccattcaaagccgaagcgtcccgcggtacctcgaaggccggcagcgcggcacctaccgtggcgacggcgttgcgcgcggcctccatccgggccaatgccgcctgggtgaacaccgacaaccccaggtcggggttgtatccgtggatctctttgacgtcgagctgggcaagaaagtagatgatctccttggaaaccagttgacccggcaccagtaccgggaagccgggcgggtagggcaccacgaacgtggtggataccagagtcttgccctcagccagccggcgcccggccaagccgatctgcacgtactcacggtcggcctcttcgtagccggcgtagaaagccgaccgcatgtcaccgaaagagctggcgtcgtcggggcggaaggcaaggtcgaactcgctgaaatctggtagatgcggcagatcctgcgtgatctcctcgacgtggcgtcggtgtagagcaaggtcggccccgctggccgccttctggctgcggtccagatcgatcgccacccgacgcaacacatcgagcagatagtgcacgctcgaccaggtgacgccgatcgtgaagatcagcaacacgctgttgatagacgttttgttgatctggatgccgaatcgctccatcaggatcttctcgcggaagtcgtacccgttcatcccggtcgccccgataaacagggtgagccgcgtcggatcgagcacgaattgatcggaccgccaggcttcgttccaatcggccagagccccctgcctgacctgacggtacgagctgaccgtcgaggaccgaaaggcatcgggaaccaggtcggactcgtcaaggatgcggaaccacttgctgatcagccggtctttgcggacgcgatggcggaacaccagcgccatgttgtaaacatggcggaccagctcgaacccttcgatgtcaacctgtcggcgcgccaagtccaacgaggcgagaagttgctggttgggcgaggtcgaggtgtgggtcaagaatgcctcaccgaacgcgtcccgggtgagcgctttgaaatcctggtcgcgcacgtggatcatcgatgcctgccgtagcgcggacagcgacttgtgagtcgaatgcgtcgcatacactcggacccgagcgcggttggggtctggcaacagccggtgatcaacccactcggagcggtccactccgtccatcgacgcacaccaattccggtattcctcagcgtattccgcagtggacaacatctgctcgagtcgctcggcagcaatcatcgcggtccgctgccgggcccagggcaccgccgtcgcaaacgcataccacgcctcgtcccacaaaaagcagatgtccggtttgatcgctagcacctcctccatcacccggcgcgggttgtacaccacgccgtcaaacgtgcagttggtgagcaacagcatgcgcacccggtgcagctgtccggcggcctcgaggtccagcagcgcctgcttgatggtgcgcaacggcacggcaccataaatcgcgtactgcggcagcggatatgcgtcgaggtacatcgggtacgcgccggcaagtaccaggccgtagtggtgcgacttgtggcaattgcggtcgatgagcacgatgtcgccggggcgggtcagggcctgcacgacgatcttgttggcggtcgatgttccgttggtgacgaagtaggtctggttggcgttccaggtcaccgcggctttgtccatcgccgtcttgatgttgccatgcgggtccagcagcgagtccagtccaccagaggttgtcgaggtctcggccatgaagatgttgcggccgtagaactcgcccatgtcgtgcagtgacttggagttgaagatgctggcgccgcgcgcgacgggaagggcatgaaattggccgaccggcgccgccgcataggcccgcagcgcatcgaaaaacggtgtggcataacggtttcgtaaacccgcgagcaccgtgctgtgcaggtcggtgacgtcgttgagccggtagaaggtgcggtcgtagacgtcgggctcgtcctgggtctcggcggcgatcgactcgtcggtgagcagatagaggtcgatgtggggccgcaactcacggatccactcggcgcattccacccagtcgtgggtctcgtttgccaccgcttcgtcgccatcggtgcccagcagcgtggtcatcagcggcacccggtcgcgggaccgcagcggcaggtcgtgacggatgatcgccgcctgaatctcgccattcagcgccaccgcggtgatggcatcttcgatgctggccaccacgagcaactcgaactgcacctcgtcggccggattgcgcaactgccgcaggcactcggccaagctgtccggagccgtcgccggggagtcgtcggcgagcagcacggtgtagaactgctgctgtttggcctgcgctaccagctcctgctccgccagtgacgcggaggtgtcgaacagcgctgtgcggtcgccgtattcggacagcagtcgtacggccaacgacacttcctcggtaagccgcaccgtggaatgactatccagatgagcgcggaaagtcgccagattctgtgcccccggatacagccagtaccgctcataggcgccgatgcggtccatcagccgcttcgcccgagccacgtcgtgtgtggtgtcgagcccggcgaggtcgacctccgccaggtgacgacacgcgtcatcgagcaggttccaggtgtccaggcgggtgtaggacgggttggccaccgcggccagcgcggagacatgcagccgtcgcgggcggacgctgtttgggttcatgtcgtcacctgttctctggtgcgggtagcgccgtagagtgcaaccaggcaattatcgcgcgcaggaccgggtcagtcagctaagtcgtcgctgtccgcgatccgccgattagcccgattcccggagttgtccacccagcgcagcaccggcagctgcgaaagctcccggcggcgtgccggcagatcggtgacgtcacccagcgagcgcaccacggcctgcgtcaggcccatgatggcggccatcaccggtagcagcggctgcaacggctttgccgccgtgcgaacagtgctgatgcggcgtgccaagatcaggcgttcgatcgcgtgatacagccaggcgccgacacccagcgcgtagatcgacattgccgaggcgacaatggtcagcccgtaggcggcgcacaccacggcaccgagcaccaccgtcgcagccaggacggccgcgaccacgacgcgcagctcgagccgggtcatcacgcccccccacgcaccgcttgagcggccgcacgcagctgcggggtcaccagcatgacctggcccagcaccccgttgacaaagcccggcgagtcgtcggtcgacagctccttggccagctggacggcctcgtcgacgaccaccggctccggcacatccgccgcgtggagcagctcccataccgagacgcgcagaatggcgcgatccacggcgggcaaccggtccagcgtccagccccgcagatgcgcggtgatcaggtcgtcgatgtgggcggcgtgttcactgacccctcgagccaccgcggccgtgtacggatgtagccgggcaatgtcgggcttcgcttcggccagcgcggcacgggtgtcgaccacctcggccgcgctgatgccgcggacctcggcctcgaacagcagggccaccgcgcgcttacgggcctgatgtcgtccgcgaaccggctttctgtccgacatcgtcaggcgttgacccggcccaggtagctaccgtcgcgcgaatccacctttagtttgtctccggtattgatgaacagcggcacgttgatctgggctccggtctgaagggtggccggcttggtgcccgcgctggaccggtcgccctgcaagccgggctcggtgtgagtgacctcgagctcgacggtcaccggcagctcgatgtatagcggcacgccgttgtggaacgccacctgcaccggcatgccctccagcaggaaccgtgccgcgtccccgaccagggcctccggcagcgggtgctgctcgtagtcttggctgtccatgaacacgaagtccgagccgtcgcggtaaaggtaggtggtatcgcgccggtcgacggtggcggtgtccaccttcaccccggcgttgaacgtcttgtcgacgaccttgcccgagagcacgttcttcaacttggtgcgcacgaacgccggacccttgcccggtttgacgtgctggaactcggtgattgtccacagctggccgtcgattaccaggaccagcccgttcttgaagtcagcagtggtcgccacgtgggtctcctacagaatggccagttctttggggaaccgggtcaacaattccggggtctgcccggcggtttcaggcattttcggcgtcccgccagccactaccaatgtgtcctcgatgcggacaccgccgcggccgggtaaatagacaccgggctccacggtcaccacggagcccgccagtagtgtaccggcggatgtgaccccgatgcccggcgcttcatgtatctgcaggccaacaccgtgtcccagtccgtgaccgaagtgctcgccgtagccggcgtcggcgatcagctggcgcgctgcagcgtccaccccccgcagctcggcacccggcagcaacgcctgccgaccggcctgttgcgcctcggccaccagctgatagatctctagctgccagtcggcggccttgcccaacacgaaggtgcgggtcatatcggagtggtacccggcgaccagggcgccgaagtcgatcttcacgaaatcgccgacctgcagcaccgcgtcggtcggccggtggtgcgggatcgccgaattggccccggcagccacgatcgtctcgaatgacaccgcgtcagcgccatgatcgagcatcagggcctccagctcgcggctcacctgccgttcggttcggcccggccgcaggccgccgcgggccaccaagtcggtcagcgcggcatcggctgcttcgcaggctagtcgcagcagcgccagctcgccggcgtctttaacctcgcgcagtgactccacagttccggatgcccgcaccaactcggtgttcttgccctccagcgcgcccgccaaggcgtccaggccgtccaccgtgaccacgtggctctcgaagcccagctttcccacgccggcctcgccggcccggccggccaggtagcgcccgaccgcgcgctcgatagccacttcgaggtcgggcgcttgcgaggcggcctgagtgcggtaccggccgtcggtggccaacacggcatcgcgctcatcggcgaacaccagcaatgcgccgttggacccgctgaagcctgatagatatcgcacgtttatcaggtcgctgatcagcatcgcatccaacccggaggcagcgatttgtgctttcagcttgtctcgacgctgggaatgtgtcacgacccttgacggtactcgctacgctgaatgcccatgactaactggatgctgcgcgggttggcgttcgccgccgcgatggtggttctccgcctgttccagggggcattgatcaacgcgtggcagatgctgtccgggctgatcagcctggtgctactgctgctcttcgcgatcggaggggtggtgtggggtgtgatggacgggcgcgccgacgccaaggcgagccctgaccccgaccgccgccaagacctggccatgacctggctgttggccggcctggtagccggcgcgctcagcggcgcggtggcctggctcatttcgctgttctacaaagcgatctacaccgggggcccaatcaacgagctgaccacgttcgcggccttcaccgcgctcatcgtctttctggtcgggatcgtcggggtagccgtgggccggtggctggtggaccggcagctggcgaaggcaccggtgcgacaccacgggcttgccgctgaacacgagcgggccgccgacaccgatgtattctccgccgttcgcgccgacgacagtccgaccggggagatgcaggtcgcgcagcctgaggcacaaaccgcggccgtcgccacggtcgaacgtgaggcacccaccgaggtgatccgcaccaccgaaagcgatacacccaccgaggttatccgcaccgacaccgaggcggaccagaccaagcccggcgacgagcccaagaaggattaaccctcacgtcccgacatgctcagctaggtaccgcagggccagcaggtagccctggatgccgagcccgacgatcaccccggtcgcgatggggctgaggtaggagtggcggcggaactcctcacgcgcatgcacgttggagatatgcacctcgatcagcggagcgctcagctccgcgcaggcatcgcgcagtgccaccgacgtgtgcgtcagaccgccggcgttgaggatcacgggttcggccgcatcggcggcctgatgaatccagtccagcagctgggcttcgctatcactttgccgcacaacggctttgagtccgagctcggcggcctcacgctcgatcagagcgaccagctcgtcgtgggtggtgccgccatagacggcgggctcgcgccggcccaaccggcccaggttggggccgttgatcacgttcacgatcagttcgctcatggggcgcaaactccggcgtaggcggttaccagcagaccggggtccggtcccaccattcggcccggcttggccaatccgtcgagcaccacgaaccgcaacacacccgcccgagtcttcttgtcgccggccatgatttccagcagctggggcagcgcgtccgggtcgtagctgaccggcaatcccaacgaggacaggatggtgcggtggcgctgcgcggtcgcgtcgtcgagccgcccggcaagcctggccagctcggccgcgaacaccagccccaccgacacggcggcgccgtggcgccaccggtagcgttcccggcgctcgatcgcgtggcctaatgtgtggccgtagttgaggatttcgcgcagctcggattccttttcgtcggcggcgaccacctcggccttgacggtgatcgcgcgccggatcagctcgggcagcacgtcgccggccgggtcgagtgcggcctgcgggtcagcttcgatgagatccaggatcaccgggtcggcgatgaagccggccttgaccacttcggccatgccgcagatcatttcgtcgcgtggcaaggtttgcagcgtcgccaggtccaccaggaccgccaacggctgatgaaacgccccgaccaggttcttgccggcgtcggtgttgatgccggtcttgccgccgacggccgcatcgaccatgcccagcagtgtggtgggcaggtgcacaatcgagacgccgcgcagccaggtggccgccgcgaacccggcgacgtcggtggcggccccgccgccgaggctgaccagggcgtctttgcggccgattccgatgcggcccaacacctcccagatgaatcccacgacgggcaggtccttgccggcctcggcgtcggggatctcgatgcggtgcgcgtcgacgcccttgccggccaagcgctttcggatctcttccgcggtctcggctagtccgggctgatgcacgacggcgaccttgtgccggtcggccagcaggtcttccagctcgtcgagcaggccggtaccgatgaccaccgggtatggcggatcgacggccacctgcacggtcacgggtgcgccgatatcggtcatgtggccgcctcgctggggctgggaacctgcagccgcgacaggatatggcggaccaccgccccggggttgcggcgattggtgtccactcgcatggtcgcgacgcgccggtacagcggtgcccgcttggccatcagcgcgcggtatttttcggcgcggtcggggccggccagcagtgggcgcacggtgttgccgccggtgcggcgcacgccctcggcggcgctgatctccaggtagacgacggtgtggccggccagcgccgcgcgcacaccggggctggtcaccgcgccgccgccgagcgacagcacaccgtcgtggtcggccagtgccgcgcgcaccacgtcctcctcgatacgtcggaactcctgctccccgtcggtggcgaagatgtcggcgatgctgcgtccggtccgctgctcgatcgcgacgtcggtgtcgagcaggccgaccccgagcgccttggccagccggcgcccgatggtggacttgccggagcccggcaggccgacgagaaccgctttgggtgccatctgttaaccggagacccgcgcggccggtgcttcgcggtcggcgacgctgcgctggtaggcggcgatgttgcgctgggtttcggccagcgaatccccgccgaatttttccagcgccgcccgggccagcaccaacgccaccatggtctccaccacgaccccggccgccggcaccgcgcacacatccgagcgctgatggatggcgacggcctcatcgccggtcgccaggtcgacggtggccagcgcgcgcggcaccgtggagatcggcttcatcgccgcacgcacccgcagcggctgcccgttggtcatcccgccttccagccccccggcccggttggtggagcggacgacgccgtcgggcccggggtacatctcgtcgtgggcgcggctgccgcggcggcgcgcggtctggaatccgtcgccgatctccacgcccttgatcgcctggatgcccatgacggcggcggccagctggctgtcgagccgatggtcgccgctggtgaacgaccccagccccaccggcaggcccagcgcgaccgcctccaccacgccgccgagggtgtcgccgtctttcttggccgcctcgatttgggcgatcatgtccgcctcggcggccttgtcgtaggcgcgtaccgggctggcgtcgatggcgggtaggtcctcggcccgcggcggcggaccctcgtagggtgccgacgcgccgatcgagatgacgtgggagagcacctcgacacccagcgcctgcctcaggaatgcccgtgcgaccgtgcccgccgcgacccgggcggcggtctcgcgggcgctggcccgctccagcaccggccgcgcgtcgtcgaagccgtatttgagcatgcccgcgtagtcggcgtggcccggccgcggccgggtgagcggggcgttgcgtgcgacgtcggccagctcggcggggtcgaccgggtcggcggccatcacggtctcccatttgggccattcggtgttgccgatctcgatggcgatgggcccgcccagggtgctgccgtggcgtatcccggacagcacggtcaccgcgtcgcgctcgaacgtcatccgtgcgccgcggccgtagcccagccggcgtcgggccagctggtcggcgatgtcggccgaggtgacgtgcacgccggcgaccatgccttcgaccacggccaccaaggcgcggccgtgtgactcccccgcggtgatccagcgcaacacctgaccatcttcccatgcgccgccggcggccaccgcacgtcaacgcacccactccgtgcgatcgcggtgatgtgcggccccccggatgccccgctagcatccctggcgtggaagtggctggcggcacccgggcccggctgcgggtcacagccgatggtttgcaggcgctggccgggcggtgcgcgaccctggccggcgaattgtcggccgcggtcgcgccgtcgggggcggtgttgtcgtggcaggccaacgcggtcgcggtgaacgccgcgcatgcccgcgcgggtgcggccgccgcggctgtgagcgcccgaatgcgggccaccgccgccgcgctggggcaggccgcccgccggtacgcgggccaggacaccgcagcggcggccgccctgggggcggtacgcccgtgggggacccactgatggctacgtcggggctgccgccgctgtcggcggtgcagtcgacgagctttgcgcatctgagcgaggccgccgcccactggcggcggctggccacgcggtgggagcgcgccttagccgaggtgcgcgattcgatgcgccgacccggcggcaccgactgggagggccaggccgcggcccgcgcccactaccggtcgaccgtcgacgtggtgacgatcggtcgcgcggtggaccggctgcatgacgccgccgccgtcgccggccgggggaagaccagctggaggccaaccggcgggcggtgctggacgctgtcagcgacgcccgccgggacgggtttgccgtcggtgaggattacacggtcaccgaccgctccacgggtggctcacgccagcagcgggcggcgcgtctgggccaagcccaggggcacgccgactttatccggcatcgggtgggcgcgctgctggccaccgaccgcgatatcgcgacccgggtcagcgccgccacccaaggcctcgatgagctggcgttcgaagacgtgcccggggtcgacaccccggccgaggatggggtgcaggcggtggatttccgccaggccccgccaccgggagcccccgggggcatgtcctccggcgacatcgacgcgatcgacgcggccaatcgcgccctgctgcaagacatgctggcggagtacagccggctgcccgacgggcaggtgaaaaccgaccggctggccgacatcgcggccatccaagaggcgctgagggtgcccgactcgcatttgatctatgtggccaggccggacgaccccgccgacatgatcccggcggtcaccgcggtcggcgatccgttcaccgccgatcacgtgtcggtgacggtccccggggtgtcgggaaccacccgtcagaccatcgccaccatgacccaagaaacccgtgggctacgagaagaagcgagagtgatcgcccacagcgtgggtgaaagtgagaatgtggcgaccatagcgtgggtggggtatcagccgccgccggtgctcgcgtcgtggaacaccgttgatgacgatctcgcgcaggccggcgctccgaagttggaggcgtttttgcgggatctgcaggcgggatcgcacaatccgggtcacacgacggcgttgttcgggcattcctacgggtcgttgctgtcggggatcgcgttgaaggatggcgccagttcactggtcgacaatgcggtgctgtatggctcgccggggtttgacgcgacctcaccggccaagctgggcatgaacgaccacaacttcttcgtgatgaccacacccgatgaccccatccggtatccggcgcgcctggcacccctgcacgggtggggatcagacggcgccgacaccatcggcactgtaggccgccaaggcacccctgcacgggtggggatcagaccccaacgagatcatcgccggatccccggaccgctaccgcttcacccatctgcagaccgacgcgggatccactccgctgggtgatcacaagaccgccgccagcgggcactcgcaatacggccaagacccgctgcaacggatgaccggctacaacctggcgaccatcctgctcaaccggcccgatctggcggtgcgcgaaagcccacagcagtgatcgcaccacaaccgatttcccgaacgctcccgcggtggcagcgcatcgtcgcgctgaccatgatcggcatatcaaccgccctgataggtggctgcaccatggatcacaaccctgacacatcacggcgcctgaccggcgagcagaagatccagctcatcgacagcatgcgcaacaagggctcctacgaggccgcccgggagcgcctaaccgccaccgcccggatcatcgccgaccgcgtcagtgcggccatcccgggccaaacctggaaattcgacgacgatcccaacatacaacagtctgaccgaaacggagcactgtgcgacaagctcaccgcggatatcgcgcggcggccgatcgccaacagcgtaatgttcggcgccacgttctcggccgaggacttcaagattgccgccaatatcgtgcgggaggaagccgccaagtacggtgcgaccaccgagtcgtcgctatttaacgaatcggccaagcgcgactacgacgtgcagggcaacggctacgaattccgactcctgcaaatcaaattcgccacacttaacatcaccggcgattgttttctgttgcagaaggtgctcgacctgccggccggacaactccccccggaaccacccatctggccaacgacctcgacgccacattgatcgcaccacaaccgattccccgaacgctcccacggtggcagcgcatcgtcgcgctgaccatgatcggcatatcaaccgccctgataggtggctgcacaatgggccaaaaccccgacaaatcaccgcacctgaccggcgagcagaagatccagctcatcgacagcatgcgccacaaaggctcctacgaggccgcccgggaacgcctcaccgccaccgcccagatcatcgccgaccgcgtcagtgcggccatcccgggccaaacctggaaattcaacgacgactcctacggccaagacttctatagaaatggatcgttgtgtaaggaactcagtgccgatatcgcccggcggccgatggccaaaccggttgacttcggtagcacattctcggcggaagacttcaagattgccgccaatatcgtgcgagaggaagccgccaagtacggtgtgaccaccgagtcgtcgctgtttaacgaatcggccaaacgcgactacgacgtgcagggcaacggctacgaattcaacctgggccaaatcaaattcgccacacttaacatcaccggcgactgttttctgttgcagaaggtgctcgacctgccggccggacaactcccccccgaaccacccatttggccgacgacctcgacgccaaccccgtgagcaccaccatcgttgctggcgtgatccagggtcacctgccggtgatcctgcccacgcgcaggcgggctcgcgatctcgggcacacgacggcgttatttcgggcgcaaacgctccaatgcatatatctcagtatcgaatacctatatgtttgctccatgtctcggcgtacaacgatcgacatcgatgacatactgctggcccgcgcgcaagcggcgctcggtaccaccgggctgaaggacagggtcgatgccgctttgcgagccgcggtgcgctagtcggcgcgcactcggctcgccgcgcgaatcgcctcgggtgccggcatcgatcggtccgaggcgctgcttgcccagacgcgtcccgcgcggtgatggtgttctgcgtcgacaccagcgcgtggcatcacgcggcgcggccggaagttgcgcgccgatggttggcggccttgtccgcggaccagatcggcatctgcgaccacgtgcggttggagatcctgtactcggcgaactccgctaccgactacgacgcgctcgccgacgaactcgacggcttggcccgtataccagtcggtgccgaaacctttacgcgcgcatgccaagtccagcgtgagcttgcccacgtcgccggtctgcatcaccgcagcgtgaagatcgccgatcttgtcatcgccgcggcggccgaactttcaggcaccatcgtgtggcattacgacgagaactatgaccgggtcgccgccatcaccggccaacctacggagtggatcgtgccgcgcgggaccctttaaccgctgataggcgccatcactggatgtatggtgatgtcatgcggactcaggtgaccctgggcaaagaggagcttgagctgctcgatcgtgccgccaaggcgagtggcgcatcgcggtccgaactcatccgacgcgcaattcaccgtgcctacgggactggatccaagcaggaacggctcgccgcgctcgaccacagccgtggctcgtggcgaggacgggacttcaccggcaccgagtatgtcgacgccattcggggcgacctcaacgaacgacttgctcggctcggtctggcgtgaagctgatcgacaccaccatcgcggtcgaccaccttcgcggcgaacccgcggcagccgtgctgctcgccgaactgataaacaacggtgaggagatcgcggccagcgagctggtccgattcgaactcctcgccggtgtgcgggaaagcgaactcgcggcgctcgaggccttcttctcggcagtggtgtggaccctggtgaccgaggacattgcccggatcggcggacgactcgcccgtcgataccggtccagccaccgcggtatcgacgacgtggactacctgatcgctgcgaccgccattgtggtcgacgccgacctgctcaccaccaatgtgcgccacttcccgatgttcccggatctgcagccgccgtactgagcactccctggggcatcagccttggtcggcgatgagttgttcgatgagctcgacgatgcgctgttggccggcggcggccccgtccagcttgcctcgcatctcggtgaatccgtcgtcgactcgactaaaacgttcttctacgtgactgaaacgttcggtcatctcttcccgcagggcggtgaaatcttctcgcagggcgttgaagctaccgattgtagctcgccggaagtcgcggaactcgccaacgaactccgtgacatcgcgatcggccgcgccggctagcacgcgagcggcggcggcatcctgttcgctggcccgcacgcggtcagccagctcacgcacttgggattccagcgcggtgacccgttgttcgaggttctcgggcagcacgagcgaatcctaccgcgattcaacgcaacgcagccctgtcccgggcggacaccggcattgggtgcacgtcggataagcagggctgagcggggctcggctctactcgggtcttacctcgacaaatccggccgcgctgaagtcaccatcgaaggcatacgcattttggatgcctttctttcgcatcaccgcgaagctcgtggcatcgacgaacgagtactctcgctcgtcgtggcgtacaagccattcccatgcctgctcttccaggtcggctgttacgtgctcgacgcgaacgacggtgctcaagcggattgcagcggcggcaaccgccgcgcggtgaccgcagcgccggttgagcagcgtccaggtctcgcccaggacatggttggaggtcatcaccacgggcggtttgctggcccacaacctcttcgcggtgccgtgccgagcgtcgccggcgttgccaagtgcagcccagaaggacgtgtcgacgaagatcattcgtgctttccgtaaaccacgtcgtcgacggacgcggacaagtcggcttcccccacgaacgatccgacgaaggcatcgaccggatctgggcccggctgccggaggtgctcagcgacgtactcccggatcagcgccgccttcgacgtccgccgccgtcgcgcttcaacagcaagcgctcggtcaacgtcttcgtcgatgtagatctgcagccttttcacatggcaaatatacgccactagcataatgctgtatacatcggtagccgagaatcggatgcttgccgctggctgccgagtttgttgaactcgccgccgtggtgacctggatgaagtgtgcccgccgaaactgccgccgcccgactaggcgactggccaaagcgatgacagtgctgacttctgtacaggggcgaagcgagtgtccgcccctttacgcgcgtcgtaatcagccgctgagttcgccatggttcccatgcaagatcgctcacgttcgagcccggcgcgcggtgaccgacatgaaactcccgttacgagcaagcatgcggcaacgccgcctcgacggcgacggtccaagctgtcctctgaacgaatcaggttgcgctaagccaagattcgttgtcaaacgacctctggtctacactgatatcgcgccaatctcagcccagcagcgccaaccccaccgcccccaggctggccacacacatcgacggcccgtgcggcagggtgcggacaccccatggcgtcaccatcacgccgcacaccgcggtcagcagcggcgcggccagcgccgccagaaaccacacctcgaccccgaagcagccggtcagcccgcccagaccgatcgccagcttgacgtcaccggcgcccatcgcggcgggcaaagccaggtgcaccagcaggtacaccccggccaaggcggccgccccggccagcgccggcacaccgcggccggcaaggcccgcgaagagcaggatcacccccgccccgggcagggtgagccagttgggtagccggcgctgccggacgtcgcaaacgcacaacactcccatccaggccaacaccgccgccgccagcatgctggggcacgctagtccaacgcggccagcgcgcaagtcatcgcttcgcggggggcgggtagcccggtgaactgctccacctgcgcgaacgcctgatgcagcaacatctgcagcccgctgatcacccgcccgcccgccgatccgaccgcggcggccagcggtgtgggccacggatcgtagatggcgtccaacagcaccgggatcgcggccaaggtgccggcataccccgcggccacctccgctggaatggtgctgaccagcacttccgcggcggccaccgcatcggccaacccaccgctgtcgaacgcgcagaaccgggtcgccacgccgacccgtgtgcccaggtccaccagccgggccgccttgtccgagttgcgcgccaccacggtgatgtcggtgaccccgagttcggccagccccaccacggccgccggtgcggtccccccggaccccagcaccagcgcgtgtccagcagccgcccccaacgccccggccaccccgtcgatgtcggtgttgtcggcccgccagccatgcggcgtccgaaccagggtgttggccgaaccgacaaggtccgcgcgtgcggtgcgctcgtcggcgaaccgcagggcggcgaacttgcccggcatggtcaccgaaacaccgacccactccggtccgaaaccaccgaccacgacgggcaactcggccgcaccgcattcgatgcgctcataggtccagtcgtgcagccccaacgcccggtaggcggccaggtgcagctgcggggagcgggaatgcgcgatcggcgaaccaagcacgccggcttttttgggaccttcgctcatcgcgcgctgtcgaggacaccgttgtgtttggccagctcgatgttcgccagatgctgctgatagtccctggtgaacagcgtcgtgccctgggaatcgatggtgacgaagtacagccagtcgccaggtactggatgctcggcggcgcgcagcgcgtcgacgccgggcgaacagatcgcggtggccggcagcccctgggccatgtaggtgttccacggtgtgcgctgggcacggtcggtgtcgctggtggccacctcacggcgatccagcggatagttcacggtcgagtcgaactccaacgtgcggtgttcgtgcagccggttgtagatgacccgggccaccttcgggaaatcctgggtgttggcttcctgctgcaccagcgaggccaccacgagaatgtcatagggcgacaggcccagcgactttgcggtgtctaccaacccggatttcatgtactccacggcgccggcgctgatcaaggtcgccaagatggtttcagccgatgccgacgggtcgatgttgaaggtccccggtgcgatcagcccctcgatccggcgatggtcagtgcccagctccatcaccggcccaaccgcccagcgcggcactgacagcatcgtcggcgtgctcctgctcgccgccgcgcggaggtcggccaccgagacgcagcgttgggtaccgtcgagatccacacaggtggcacgggagatcagcgcgaatatgccaggattcaccacgttggtcttcatgtcggtggtgtcgtcgagctgacgcccttccggtatgaccaacttccccacccggttgtgcggatcggtaagccgcgcgacagcggaagccgccgaaatctcggttcgcatccgatagaacccgggttggatcgaggaaatcgcggtgttgccgtgcgcggcatcgacgaatgctcggacggtggccactacaccgtgtttgagcagcgtctccccgaccgccgtggtcgagtcaccggccctgatctgaatcacgatgtctcgcttgccgggaccggtgtagtcgttaccgaagcccaacatggtctgccacaacttggcgccgacgacgacggccaccaccaccaccacgacgagcaggctcagggcaaatccgccggcgacgcgccgtcgccggcggatttgttgggcgtgtcggcgctgagcgcggctgactcgggtcctgcggtgccggttcggtcttaccgacaccggctgggcgcggtggcggtggccaccgtcaggcatcggagccttcttgagtcccggccatcgccgcgagacgttcatccagccagctctgcagtattgccactgcggccgcttggtcgatcaccgcacgctgctcggaggcccgcacccccgcctgccgcaaagatcgttgagcactgaccgtggtgagccgctcgtcggccagccgcaccggcgtaggagaaacacggcgtgccagcgcctcggccagttcgattgcgtcttgggccgagcggccgatgcggtcggccagcgtgcgcgggagcccgacgatcacctcgaccgcctccaactcggcggccagcgcagccagcctgcgcaggtgcttgccggaacgatcgcggcgcaccgtttccaccggggtggccaagatcgcgtccgggtcgctgcaagccacgccgatacgcgcggcgcccacgtcgataccgaggcgtcgtccccgtccagggtcgtgcgctggatcgccgggccggtcgggcgggcggtgctgtgctgggaccactcaaccgacccgcgctatcacggcgatctcggagcggaccgcgtcgagcgcggcgtcgataccggtcggattctttcccgagccctgcgccaggtccgccttaccgccaccgcggccttcgaccgccaccgcaagttgtttgaccaggtcgttggcacggattccgaggtcctgggcagcgggattggccgcgaccgcatacggcacagtttggctttcgccctcggcaatcagcgccaccaccgccggctcgctacccagcttgccgcggatgtcgccgatcaacgaccgcaggtctgccgcggtcatcccgccggacattcgctgcgccaccaaacggacgttaccgatccgctgagccccggcggcggcattggtggcggctgcccgggcgctggccatccggacacgttcgagttccttctcggcggcccgcaggcgctccactagattggccacccgggccggtacctcttcggacggcaccttcagtgacgaggccaacccggccatcaacgcacgctccttggccaggtgacgaaacgaatccaaccccacgtaggcctccacccggcgcaccccggagccgatcgacgactcgcccaggatcgtcacgggaccgatctgcgccgtgttgctcacatgggtgccgccacatagctccagcgagaacggtccacccatctccaccacccgcacttcgtcggggtagctctcgccgaacagcgcgatggcacccatcgccttggccttgtcgagctgttcggtgaacgtgcgcacctcgaagtccgcttgcacggcctcgttggtgacctcttcgacctgggtgcgctggtcgtcggtcaacggaccctgccagttaaagtcgaagcgcaaatatcccggccggttcagcgatcccgcctgaaccgcgttgggccccagcacttgtcgcagcgcggcatgcaccatgtgggtgcccgagtggccctgcgtggcaccccggcgccacccgggatccaccgccgcgattacggtgtcaccctcgacgaattccccggattccacgttgactcggtgcacccaaagcgttttggcgatcttctgcacgtcggtaaccgcggcccgggcagcttcgctggaaccggttccgctgatggtgccctcatcggcgatctgcccacccgattcggcgtagagcggggtgcgatctaagacaagttcgacacgctgcccttccccggctccgccggctacaccgtgcgccaccaccggaacccgcttaccgtcgacgaagatgcccagaatccgcgcctgggaacgcaactcgtcgaatccggtgaactcggtggcgccggcgtcaaccagctcgcggtaggcgctcaggtcagcatgcgcgtgtttgcgcgcggcggcgtcggccttggcacggcggcgctgctcggccatcagctcacggaacccgatttcgtctacctgcagaccggtttcggccgccatctccagcgtgagctcgatcgggaacccgtaggtgtcatgcaacgtgaaagcgtccgatccggacagcacggtggctccggatttcttggtggagctagccacctcctcgaacagcctggaacccgacgccagcgtgcggttgaacgccgtctcctcggcgaccgcgatccggctgatccgctcgaagtcggcgacgagttcgggatatgacgggcccatcgcgttgcgcaccgtggccatcaggtcgccaacgatcgcagcgtcgatgcccagcagcttggcggagcggatcacccgacgcagcagccggcgcagcacataaccgcgaccgtcgttgccggggctgacgccgtcaccgatcaggatcgcggcggtgcggctgtggtctgcgatgatgcggtaccgcacgtcgtcttcgtggttgccgacgtcgtaggcacgcgcggcgaccctggccacggtatcgatgaccggcctgagcaggtcggtctcgtagacgttgtgcacgtcttgcagcaccagcgcgatccgctcgacgcccatgccggtgtcgatgttcttgcggggcagcggcccgaggatctggtagtcctccttggtggttccctctccgcgctcgttctgcatgaacaccaggttccagacctcgaggtagcggtcttcgctgacgatgggaccgcctgcgggaccgaattcgggtccgcggtcgtaatagatctccgatgacggcccgcacggtccgggaatgcccatcgaccagtagttgtcggccatgccgcggcgctggattcgctccgccggcagcccggcaacctcctgccatagccggacagcttcgtcgtcgtcgaaatagactgtcgtccagattctttccgggtccaggccgtagccgccggcggcgaggctgttggtcagcagtgcccaggccagttcaatggccccgcgtttgaaatagtcgccgaagctgaaattgccggccatctgaaaaaacgtgttgtgccgggtggttatgcccacctcgtcgatatcgggggtacggatgcacttctggatgctggtggccgtcgggtacggcggcgtgcgctgtcccaagaagaaaggcacgaactggaccatcccggcgttgacgaacaacaggttggggtcgtcgaggatcaccgaggcgctgggcacctcggtgtggcccgccttcacgaaatgatcgaggaaccgcttcctgatctcgtgtgtctgcactctacgttcttccttgatccgtggttaagtccattaccagcctattcgccggattatgagaaggctgtccgacggcccaattcggcccgctcagccttccacaaagctcaatcgcaccgaccgccgcggattgtcctggttgaggtcgaccagaacgatgctttgccaggtgcccagcaggggctggccccccgagaccggcaccgtcaccgacggcgcaacaaaagccggtaacaagtggtcggcgccgtgaccgtaggacccgtgcgcgtgccggtagcggtcgtcgcgcggcaacaaccgcaccagcgtgtccaccagatcctcgtcggaaccggcgccggtctcgataatcgcaacgccggccgtagcgtgcgggacgaacacgttgcacaggccatcatcatgggcggtgcagaaggcgcgcacggcgtcggtgagatcgacaatgcggcgacgcgcggtgtccacatccagcacatcggtatccacccgtcccagcctacggtgggggcgcgccaacctgccaatccattgacgtcggattgcccattgccccggccggcccgtcggaggaaggtaatgattgaccggtggcgccaccggggcgctgccccgaacaatgaaagaggggtggatcgtgtacgcgcgctctaccactattcaggcgcaatccgagtgcatcgacaccggaattgcgcacgttcgcgatgtggttatgcccgcactgcaggggatggatgggtgcatcggcgtatcccttttggtcgaccggcaatccggcaggtgcatcgccaccagtgcctgggagaccgcggaagccatgcatgcaagccgggaacaggtaacgccgatccgcgatcggtgcgcggagatgttcggcggcacgccggccgtcgaggagtgggagatcgcggcgatgcatcgcgaccaccgctcggccgagggggcgtgtgtgcgggcgacctgggtcaaggtgccggcggaccaagtagatcaaggcatcgagtactacaagtcgtccgtcctgccccaaatcgaaggcctcgacggattctgcagcgccagcctgttggtcgaccgcacctccgggcgcgcggtgtcttccgcgaccttcgacagctttgacgccatggagcgcaaccgggaccagtcgaatgcgctcaaggccacatcgctgcgtgaggcgggcggcgaggaactcgatgaatgcgagttcgagctggcgctagcgcacctacgggtacccgagctggtctgatcaacccgccggcggcagtaccggcccgagcccgacgctgggccggcactgctgtcgtgcgtcgagcggcgctcgcggtaggcattgccaggctcagccggttggaggaaggtatttggtgggaccggtggcgccaccggggcgctgccccgacacgggagggggtcgatcgtgtacgcacgctcaaccaccattgaggcgcaacctctgtcggtcgacattggaatcgcgcatgttcgtgacgtcgtcatgcccgctttgcaggagatcgacgggtgtgtcggggtgtcgctgttggtcgaccggcaatccggccggtgcatcgccaccagcgcctgggagaccttggaggcgatgcgcgccagcgtcgagcgggtggcacccatccgcgaccgcgccgcgctgatgttcgccggtagtgcccgggtcgaggaatgggacatcgccctgttgcaccgcgaccacccgtcgcatgagggggcatgcgtgcgcgccacctggctcaaagtggtgccagaccagctcggtcggtccctggagttctaccgcacgtccgtacttcccgagctggagagtctggacgggttctgcagcgccagcctgatggtcgaccaccccgcttgccggcgtgcggtgtcgtgctcgacgttcgacagcatggacgcgatggcccgcaaccgcgaccgggcgagcgagctgcgcagcaggcgcgtccgggaattgggagccgaggtcctcgacgtcgccgaattcgaactggcgatcgcacatctacgggtacccgagctggtctgagcggacctgcttcccgcagagcgcagcggtcacccccgtttcttgcggatgattgcccgcaggcggtccaggcggccggcgatctcgcgttcgccgccgcgaccagtgggccggtagtagtccacgtccaccaactcgtcgggcgggtattgctgggccacaacgccatccgggtcgtcatgggaatatttgtagccctgtgcattgcccagcgccgccgccccggagtaatgcccgtcacgcagatgagccggcaccagaccggccttgccggccttgatgtcgttcatcgccgcggccaacgccgtggtgacggcgtttgacttcggtgcggtggccaggtggatggtggcgtgcgccagcgtcagctgggcttcgggcatgccgatcagcgccaccgtctgtgcggcggcgaccgccacctgcagcgcgctcgggccggccatgccgatgtcctcgctggccagaatcatcagccggcgggcgatgaaccgcgggtcctccccggcgaccagcatgcgggccaaatagtgcagcgcggcatcgacgtcggaaccgcgcaccgatttgatgaaggcgctgacgacgtcgtagtgctggtcgccgtcacggtcgtagcgcaccgcggctttgtccaccgaccgctcgatggtttgcacgctgaccagctcgccggccgcctgggctgcctcggccgctacttccagcgcggtcagggcgcgccgggcgtcgccggccgcgagttgcaccagcaggtcgacggcctcaggcgctaccgcgactgccctgcccaggccgcgggggtcatcgatcgcgcgttgtactaccgcgcgggtgtcctcggccgtcagcggccgcagctgcaggatcagcgaccgcgacagcagcggtgccaccaccgaaaacgacgggttctcggtggtcgccgccaccaacagcaccacccggtgttccaccgccgacagcagggcgtcttgttgggtcttggaaaatcggtgcacctcgtcgatgaacagcacggtctgctcgccgtgaagcagcgcttttcgcgaattctcgatgaccgcccgcacttccttgacgccggccgacaatgccgacagggcctcgaaccggcggccggtggcctgcgagatcaacgccgccagcgttgtcttgccgctgcccgggggaccgtagaggatcaccgacgccacccccgagccctcgaccagccggcgcaacggcgaaccgggcgccagcaagtggtcctggccgaccacttcgtccagcgacgccggacgcatccgcaccgccagcggtgccccggccgaagcgcccaggtcatggccggacgtcatcggtacgccgggcacgtcaaacagaccgtcggacacggcttcaggcataccacgcccacctgacgacgcgaacgttcgccgaagacgccacacgaataatccgcgcgccttcggcaaatatttgctaagttccggtttgcttagcgtcgcgcgggtaccgataaaagcgaactacgaagcgattgggacagcgatgagccagccgccagaacatccaggcaatccggccgacccccagggcggcaatcagggcgctggaagctacccgccgcccggctacggagcgcctcccccgccaccaggctacggcccacccccggggacctacctgcctcccggctacaacgcacccccgccgccccccggctatggcccaccgccgggcccgccgcctcccggttacccgacgcatctgcaatcgtcgggttttagcgtgggcgacgcgatcagttggtcatggaataggttcacgcagaacgccgtaacgctcgtcgtcccggtgctcgcctacgctgtggcgttggccgcggtcatcggcgcgacggccgggctcgttgtcgccctatcggaccgtgctactaccgcatacaccaacacctccggcgtctctagcgaatccgtggacatcacgatgaccccggccgcgggcatagtcatgttcctcggctacatcgctctattcgccctggtgctctacatgcacgccggaattctgaccggctgccttgacattgccgacggaaagccggtgaccatcgcgacgttctttaggccgcgcaatctgggcctggtgctggtcaccggactgctgatcgtcgccgtcaccttcattggtggcctgctctgtgtcattcccggcctgatctttggcttcgtcgcccagttcgccgtcgcttttgccgtcgaccgttccacttcgccgatcgactcggtaaaggccagcatcgagacggtcgggtccaacatcggtggcagtgtgctgtcgtggctcgctcagctcacggcggtgctcgtcggcgaactgctgtgctttgtcggcatgctgatcggcattccggtcgccgcgctcatccacgtctacacctaccggaagctgtcgggtggccaagtcgttgaggcagtccggccagcgcccccggtcggctggccgcccggcccccagctcgcatagtcggcacccgccgacgccggctggccgtcttggcccgctggatttgtcacgcgctcacccgaattggcatccggggcctggaacgcgttagggcagtggctttcccacaggttgacgtaaatgacctccaagataggtatcgaaccaaggttgcggccgatgtgtacgtagttcgagagttcgctgatctgatcactcgcgtggtcgatgcagtcgacggaaccggcagccgccacccaagggtgcgcaggtggttagcaaatcgccgacgaacacgacgccaccgcgtcatgcgccatcgccgaccccgccttggtggctgagagccgctcgccggcgttaagctgcccaacatcatgggcattcaacgcgccgttctcctcattgccgacatcggcggatacacaaattacatgcactggaaccgcaagcacctggcccacgcgcagtggacggtggcacagttgctggagtccgtcatcgacgctgccaagggcatgaagttggcgaagctggagggcgacgccgcgtttttttgggcaccaggggggcaacaccagtgtcctggtatgcgaccggcccccgcagatgcgccagaggttccgcacgcggcgcgagcagatcaaaaaagaccatccctgcgactgtaagagttgcgagcagcgggacaacctgtcgatcaaattcgtcgcccatgagggcgaagtggccgaacaaaaggtgaagcgcaacgtcgaactcgctggcgttgatgtcatcctggtgcaccgcatgctgaaaaatgaggtgccagtgtcggaatatctattcatgaccgacgtcgtagcgcagtgcctcgacgagtcggtgcgaaaactagcgacgccgctgacacatgacttcgagggcatcggagaaacgtcgacacactacatcgacctcgccacgtccgacatgccgccggcggtgccagaccacagcttcttcggcctgctgtgggcggatgtgaagttcgaatggcacgcgttaccgtacctgttaggtttcaagaaggcctgtgcaggtttccgcagcctgggccgcggcgccaccgaagagcccgccgaaatgggctaatcgggttcgcttggctcgatcgccgatgatctcgaccgccacgaccgaccccctcacctcggtcgaacctcggcgaaccaacgcggcaacgccagcccatgatcatttgattgggtccacggaagcaggtagcttccgtcgcatgctttttgcggctttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatctgcaagtgggtgcgcgcactttgcggatcgtcggcatcgtgcccgagtcaaccgcgctggcaaagattcccaacatcttcctgaccaccgaaggcctacagcagttggcatacaacggacagccgacaatcagttcgatcgggatcgacgggatgccccgacagctcccggacggctatcagaccgtcaatcgagcggatgctgtcagcgatctgatgcgcccgttgaaggtcgcggtggatgcgatcacggttgtggcggtcttgctgtggatcgttgcggcgttgatcgtcggctcggtggtctacctctctgcgttggagcggctgcgtgactttgcggtgttcaaggcgatcggcgtgccgacgcgctcgattctggccgggctggcgctgcaggcggtcgtcgtcgcgctgctcgcggcggtggttggcggcatcctttcgctgctgttggcgccgttgttcccgatgactgtcgtggtacccctgagtgccttcgtggcgctaccggcgatcgcgactgtgatcggtctgctggccagcgtcgcaggactgcggcgcgtggtggcgatcgatccggcactagcgttcggaggtccctagccatgggcggcctaaccatttccgacctggtcgtcgagtattccagcggcgggtacgccgtgcggccgatcgacgggttaagcctcgacgtggcgccggggtcgctggtgatcttgcttgggcccagcggctgcgggaagacgaccctcttgtcctgcctcggcggcatcctgcgcccgaagtccggctcaatcaagtttgacgatgtcgacatcacgacgctggagggcgccgcgctggcgaagtatcggcgtgacaaggtagggatcgtcttccaggcgttcaacctggtctcgagccttaccgccctggagaacgtgatggtcccgctgcgcgcggccggcgtgtcacgagcggccgcgcgtaagcgtgccgaggacctgctgatccgagtcaatctcggcgaacgaatgaaacaccgcccgggtgacatgagcggcggccagcagcaacgcgtcgcggtcgcccgcgcgatcgcgctggacccgcaattgatccttgccgacgaaccgaccgcgcacctggacttcatccaggtggaggaggtgctgcggctgatccgctcgctagcgcagggcgaccgtgtggtggtggtcgcgacccacgacagccggatgctgccgctggccgatcgcgtccttgagctgatgccggcgcaggtgtcgccgaatcagccacccgaaacggtgcacgtgaaagccggcgaggtgctgttcgagcagtccacaatgggcgatctgatctacgtggtgtccgagggcgagttcgagattgtgcgcgaattggccgacggcggtgaggaattggtcaaaaccgccgcgcctggggactacttcggtgaaatcggcgtgctgtttcacctgccacgctcggcaacggtacgggctcgcagcgacgcgacagccgtcggttatacggcgcaggcgtttcgggagcggctgggtgtgacgcgggtggccgacctgattgagcaccgcgagcttgccagcgaatagttcggcaccaagtcgcgatccctgagggttgcgatgggcgcggcgccgccgctgaatcgaccgccccccactgagccgccgtggaatactcgatgaatcctgcgggcgtgtccgcactgcgtgtggctatggagttggggaacatgttgcttgggataagaacgtgaatgagggaccgctcttcacaatgtcaggcactgccgtgagaagtccgctactcgatcgggtgtatgtgagcagtcctggcatgggccgagatgccaagagccgcatctcatgaccaccgcgcgacgacggcccaagcggcgtggtaccgatgcgcgaaccgcgctgcgcaacgttccgatactcgccgatatcgacgacgaacagctcgaacgactcgcaaccaccgtagaacgccgccacgtgcccgctaaccagtggctctttcatgccggagaaccagcggactccatctatatcgtcgactcggggcggttcgtcgctgttgccccagagggacacgtatttgctgagatggcatccggcgactcgatcggagacctgggggtgatcgccggggctgcccgctcagcgggagtgcgagctctgcgagacggcgtggtgtggaggatcgccgcggagacgtttaccgacatgctcgaggcaaccccgctactgcaatcggcgatgctgcgagcgatggcgagaatgctacgccagtcacgacccgccaagacggctcggcgtccgcgggtcatcggcgtggtatcgaacggggacaccgccgcggccccgatggtcgacgcgatcgctacttcactggactcgcacggtcgaactgccgtgattgcgccgcccgtcgaaaccacctccgccgttcaggagtacgacgagctcgtcgaggcgttcagcgaaaccctcgatcgcgcggagcgaagcaacgattgggtcttggtggtcgccgaccgaggcgccggcgacctgtggcggcactacgttagcgcgcaaagcgaccgactcgtggtcctggtggatcaacggtatccgccggatgcggtcgattcgcttgctacccaacggccagtgcacctgatcacatgtctggcagaaccggatccaagttggtgggatcggttggcgccggtttcgcatcatccggccaactccgacggcttcggtgcccttgctcgcagaatcgccggccgatcgctcggcctggtgatggccggtggcggagcccggggactggcgcatttcggtgtttaccaagagctcaccgaagccggcgtcgtcatcgatcggtttggcggaacaagttcgggtgcaatcgcttccgcagcgttcgcgctggggatggacgccggggatgcgatcgccgcggcgcgagagttcatcgcaggaagcgacccactcggcgactacacgatcccaatatccgccctcacgcgaggtggacgcgtcgatcgtctggtgcagggattcttcggcaacacgttgatcgaacatctgcccagagggttcttctccgtctccgccgacatgatcaccggcgatcagatcatccatcggcggggatccgtctcgggcgccgtgcgcgcatcgatctcgatccccggtctcatcccgccagtgcacaatggcgagcagctgctcgtcgacggtgggctgttgaacaatctgccggccaacgtgatgtgcgccgataccgatggcgaagtcatctgcgtcgacctccgccgaacgttcgtgccgtcgaagggctttggcctgctgccgccaatcgttacgccgcccgggctcctccggcggcttttgaccggcacggataacgcgctaccaccgctgcaagagacgttgctgcgcgccttcgaccttgccgcctccaccgcaaacctgcgcgagcttcctcgcgttgcggccatcatcgagcccgacgtgtcgaagatcggagtgttgaacttcaagcagattgatgccgccctagaggctgggcggatggcagcccgtgcggctttgcaagcacagccggacctggtgcgctgaacccgaccaagtgccgctacggcccactcaggtgtccggcaccgggcgtacgcgctgcgccgggcggtccggtgtgatctcatcagcagctatgagcatcaaagttgcgctggagcaccgcaccagctacacctttgaccggctggtgcgggtgtatccgcacatcgtgcggctacgcccggcgccgcactcccgcacctccatcgaagcctactcgctgcgcatcgagcccgccgaccacttcatcaactggcagcaggacgcgctgggcaactttctggcgcggctggtctttccgaatcccatgcgccaactgcgtattaccgtcgggcttatcgccgacctcaaggtgatcaaccccttcgacttctttatcgaggactgggccgagatatggccctgcgcagggatggcctaccccaaggcgctcgccgatgacctgaggccgtacttgcggccggtcgacgaagacggcgacggttcgggccccggcgagctcacgcaggcctgggtgcgcaacttcacggtgcccgatggcacccgcaccatcgacttcttggtcgcactcaaccgcgcgatcaacgccgacgtcggctactgcgtgcgcatggagcccggagttcagacaccggatttcacgctgcgcaccggcgtcggctcgtgccgggactcggcgtggctgctggtctcgatcctgcgtcagttcgggctggccgcccggttcgtgtccggctacctggttcagctggcatccgacatcgaagcgctcgacgggccgtcggggcccgccgccgacttcaccgacctgcacgcgtgggccgaggcatacatcccgggtgccggctggatcgggctggacccgacgtcggggctgttggccggcgagggccacattccgctggcggctacgccccaccccgccagcgcggcacccatcagcggcggcaccgacgtgtgcgacaccgtgctggagttctccaacaccgtcacccgcgtacacgaagacccacgtgtcacgttgccctacaccgacgagtcctggaagaccatctgtgaggtgggccagcgcgtcgatgagcggctggccgccgccgacgtccggctgaccgtcggcggcgaaccgacgttcgtgtcggtggataaccaggtcgccgaagagtggcggacggcggccgacggcccacacaaacgcgaacgggcatccgacctggccgcccgcttgaaggcggtgtgggccccgcagggactcatccaccgcggtcagggcaggtggtatcccggagagccgttgccgcgctggcagattgcgctgtattggcgcaccgacgggcggccgctgtggaccaacgacgcgctgttggccgacccctggggcgccccgcccgccgaccccgtcgacgacgacgcggcctaccgggtgctcgccgggatcgccgacggcttggggctgccgatctcgcaggtgcggcccgcctacgaagacccgttgagccggctggctgcggccgtgcgaatgccagccggcgacccggtggaatccggtgacgacctcggctgcgacaccaaccccgacacccccaccggccgcgccgcgctgctggcgcgcctcgatgaggccatcacctctccggctgcgtacgtgctgccgctgcaccgccgcgacgacgggcaaggctgggccagcgcgaactggcggctgcgccgcggtcgcatcgtgttgctcgaaggggattcgccggcgggcctgcggctgccgctggattcgatcagctggcgcccaccccgggcatcgtttgacgccgacccggtagctgtgcgatccacattgccggcggagctccacaccgaccgggccgtagtggaggatcccgagacggctccgaccaccgcgttggtcgccgaggtccggggtgggctggtgcacatcttcttgccgcccaccgacgcgctcgagcacttcatcgaccttgtcgcccgagtcgaggccgcggcgacgacggccaactgcccggtggtgatcgagggctacggcccacccccggacccgcggctgacgtccaccacaatcacccccgaccccggcgtcatcgaggtcaacatcgcgcccaccgcctcttttgcagaacaacggcaacagctggaaaccctgtatcaacaagcgcgcctggcccgactcaccaccgaagcgttcgacgtcgacggcacgcacggcggcaccggcggcggcaaccacatcacgcttggcggcgtcacacccgcggactcaccgctgctgcgccggcccgacctgctggtttcactgctgacctactggcagcgacacccgtcgttgtcctacttgttcgccgggcgtttcgtcggcaccacgtcacaggcgccccgggttgacgagggccgcgccgaggcgctctacgaactcgagatcgcgttcgccgagatcctccggctgtcgccgtcgtccgggggcggccggccccaaccgtgggtgaccgaccgcgcgctgcggcacctgctcaccgacatcaccggcaacacccatcgcgccgaattctgcatcgacaagctctacagccccgacagcgcccggggcaggctcggcctgctggagctccgcgggttcgagatgccgccgcacctgcacatggcgatggtgcagtcgctgctggtgcgctcgctggtggcgtggttctgggaccaaccgctgcgcgccccgctgatccgccacggcgccaacttgcacggtcgatatctattgccgcacttcttgattcatgacatcgccgacgtcgcagccgacctgcgcgcgcacggcatcgcgttcgagactagctggctggacccgttcaccgagttccgcttcccgcgcatcggcaccgccgtattcgacggcattgagatcgagctgcgcggggccatcgagccatggcacacccttggcgaggaggccaccgcggcaggcaccgcgcgctatgtcgactcgtcggtcgagcgcatccaggtccgcatcatcggcgccgaccggcaccgctacgtggtgacctgtaacggctacccgatgccgttgctggctaccgacaaccccgacatccacgtgggtggtgtgcggttcaaagcgtggcagccgcccagcgcgctacacccgaccatcacggtcgacggcccgttgcggttcgagctcatcgacatcgccaccgctacctcgtgcggcggctgtacctaccatgtcgcccatccgggcggccgcgcctacgacgagcccccggtcaacgctgtggaggcggaggcccgccgcgcccggcgcttcgaggcgaccggcttcaccccgggcaagctcgacctgtccgacatccgggagaaacaggccaggatatccaccgatatcggcgcgccgggcatcctcgacctacgacgcgtgcgtaccgtgcaacagtaatggcaccctcagcttctgccgctaccaacggctacgacgtcgaccgcctgctggccggataccgcaccgcgcgtgcccaggaaacactgttcgacctgcgggacggcccgggagccggctatgacgaattcgtcgacgacgacggcaacgtgcgaccgacctggaccgagctcgccgacgcggtcgccgaacgtggcaaggcggggctggaccggctgcgctcggtggtgcacagcctgatcgaccacgacggcatcacctacaccgcaatcgatgcacaccgggacgcgctgaccggcgaccatgatctggaaccggggccgtggcgcctggacccgctgccgctggtgatttccgcggccgattgggaagtgctggaggccggcttggtgcagcgatcgcgcttgcttgatgccatcctcgcggacttgtacgggccccgcagcatgctcaccgagggtgtcctgccgccagagatgctgttcgctcatcccggctacgtgcgtgccgctaacgggatccagatgcctgggcgccaccaacttttcatgcacgcctgtgatctcagccggttgcccgacgggacttttcaggtcaacgccgactggacgcaggcgccctcgggctccggctatgcgatggccgatcgacgtgtcgtcgcgcacgccgttcccgatctgtacgaggaactggcgccgcgacccaccacaccgttcgcccaggcgctccggctggcactgattgacgcggcacccgatgtcgcccaagaccccgtcgtggtggtgctcagcccgggcatctattcagaaaccgctttcgaccaggcgtatctcgcaacgctgctgggtttcccgctagtggaaagcgcggacctggtggtgcgcgacggcaagctgtggatgcgttcgctgggcacgctgaaacgcgttgacgtcgttcttcgccgcgtcgatgcccactacgcggatccactggatctacgcgccgattccaggctcggtgtcgtcggtttggtggaagcgcagcaccgcggaacagtgaccgtcgtcaacacgctgggcagcggcatcctggagaacccaggcctgttgcgcttcctgccgcagctatccgagcgcctgctcgacgaaagcccgctgctgcacaccgctccggtctactggggcggcatcgccagcgaacgctcacacctactggccaatgtctcgtcgctgctgatcaaaagcactgtcagcggggaaactcttgtcggaccgacactttcgtctgcacaactggccgatctggcagtgcgtatcgaggcgatgccgtggcagtgggtgggccaggagctgccgcagttctcgtcggcgcccaccaaccatgccggggtgttgtcgtccgccggggtaggcatgcgactgttcaccgttgcccagcgcagtggttacgcgccgatgatcggcggcctcggctatgtactggcgcccggccctgccgcatatacgctgaaaaccgttgcagcaaaagatatctgggtgcgcccaacggagcgtgcgcatgccgaggtgataacggtgccggtgttggcgccgccggccaaaaccggagcgggcacctgggcggtcagctctccgcgcgtgctgtccgatctgttctggatgggccgctacggcgagcgcgcggagaacatggcccggctgctgatcgtcacccgcgagcgctaccacgttttccggcaccagcaggacaccgatgaaagcgagtgcgtgccggtgctgatggccgcgctgggcaagatcaccggatatgacaccgcaactggcgccggcagcgcttacgaccgggccgacatgatcgcggtcgccccgtcgacactgtggtctttgaccgtggatccggaccggccgggttcccttgttcagtcggtggaggggctggcacttgccgcccaggcggtgcgcgaccagctgtccaacgacacctggatggtgctggccaatgtggaacgcgcggtggagcacaagtccgacccgccgcagtcgctggcagaggcggacgccgtgcttgcgtcggctcaggcggagacgctagccggcatgctgacgttgtccggggtggccggcgagtcgatggtgcacgacgtgggctggacgatgatggacatcggcaagcgtatcgaacgcggcctgtggctgaccgcgttgctacaagccacgttgagcaccgtgcgccaccccgccgccgagcaagccatcatcgaggcaaccctggtggcgtgtgaatcgtcggttatctatcggcgccgcaccgtaggcaagttcagtgtcgccgctgtgaccgagctgatgttgttcgacgcccagaacccgcgctcgctggtgtatcagctggaacggctgcgcgccgacctgaaagacctgcctggctcgtcgggatcgtctcgtccggaacggatggtggacgagatgaacacccgcctgcgccgctcacacccagaagagttggaagaggtctccgccgacgggctgcgcgccgagttggcggaactgctggccgggatacatgcctcgctgcgtgacgtggccgacgtcctcaccgccactcagttggcgttgcccggcggcatgcaaccgctgtggggtccagaccaacggcgggtgatgccggcctaaacggtgcgacggctgtgagccggctcgaaatccggggccacctcgtcgacgacggtgtggatgaaccgcatcttctccagcacagcggccggcagcacaaaggggtataggtcgtcgtggcccatcgagcgattgaccatgttcagcgaccacgacagcggcagccacttgtcgatgatggtattaaaagcgctggggcccaacgccggccggtcgaaggttgccgacgccggtgccaggccgcaccaggccgcggtgtccagggcgtcgcggatatgcaggtaatgagcgaacgtctcggcccaatcctcactcgcgtgcatggtcgcatacgacgagacaaagctgtcctgccaaccttccggcgggccgccacggtaatgccgatccaacgcctgggagtagtcagcgtccgggtctccgaacaactcgttgaaccgggacagatagtcgcttgacgaggcgatgagtcgatagaagtagtagtgcccgatctcgtggcggaagtgcccaagcagggtccgatacggctcgtccatctcgacccgcagctgctcccgatgcacatcgtcgccttcggcgagatccagtgtgatgactccgttctggtgtccggtggtcacgttctcgtgcgcgctggacaatagccggaaggccaacccatggtcaggatcctggtcgcggccgacgatcggcagcttcagctcgtgtagctcggcgatcagccgccgcttggcaccttcggctcgggcgaactccgccagcccggcggtgttggtatcgctgggccgctcgatggtcagcacacaagaactgcaaagtccgccgagctgatcactgggcaccagccaattgcattgcgcgaggtggagattggcgcagagttggacatcggcgtcgtcggcgatgaccagcagcgccatccgcccaagagaaaaccccagcgcgctgccgcacgacaggcaggcggagttctcgaatgccaggcgctgcccgcaatttggacagtggaagtcacgcatgcagcgcatcaccttcgaagggcacgacatcgacagaaacgtcgatcacactgttctcggagttggtgtagatgatgccgcgtagcggcggcacgtctgcgtagtcgcggccgcggcccacgacgatgtagcgctggtcgaccaactggtcattggtgggatccagccccagccactcgaaccgcccgggctgctgcggagtccacaccgaggcccaggcatgcgtcgcgtcgatgccgatcatccgatcctttccgggcggcgggtcggtggccaggtagcccgacacataacaggccgccaaaccgttggcccgtaggcaggcgatcgccagcctggcgaaatcttggcataccccttcgcgggccagcagcacctcgttgactcctgtggaaatcgtcgtggaacccgagcggtaggtgaagtcggtgtagatccgcgacgcgagatcgcgcaatacctcgaccagggggcgtttgggcaggaagctaggagccgcgtactcacgcaccgcatcggtgatctccggcgggttcaagtccagggtgaactcggtggctagcgatccgggcagcccggcgggccgggccgcctcccacggttgcagcgccggcccgctggtgtaaagcccgggcggcggcggggacacgtcgacgatggaatcgctggtgatcgtcaaggtgcggtgcggttcggtgacgtggaaataggagctgatgttgccgtacccgtcgcggctggtggaccggtcggcgggggccgggtcgatggtcagccggtgtgcgacacaacgctgccgcagcgaattccgcggcgtgagaaacccgcggccataggagctggtcaccacgtcggagtagcggtattcggtgcggtgtgttactcgatagcggtgagtgcccgacaacggcaacgacaacgagctatctgctgacaaaaagctacctcctggctgatcacatcacacgccggcggctcgtccggcgcgatcgtcgcgcaatgtggcgccaagcgcaccatagccggagcacaattaaagcgtggctacctgggacgacgtcgcccgtatcgtgggtgggctgccgctgaccgcggagcaggcaccgcacgactggcgtgttggccgcaagctgctggcctgggaacggccgctgcgcaagtccgaccgcgaagccctgaccagggccggatcggagccaccgtccggcgacatcgtcggtgtccgagtgtcggacgagggggtgaagttcgccttgattgccgacgagccgggcgtgtacttcaccaccccgcatttcgacggctatccagcggtgctggtcaggctggccgagatcgaggttcgcgacctcgaggagttgatcaccgaggcctggctgatgcaggcgccgaagcagctggtgcaggcgtttctcgccaattcaggctgacatgcccgacgggcccgggcgttcgattacccgttgtagatcggtgacacacgcttggacgatatcggcgcgcaccacttcgttgctgccacaagcagccgattgcagtgtcgacgcggttgcgcgggcggcggccgcgtgctcgttcgctgccgtcggatccgcgtcggccaggccggttcccgcggcgaggtcggtgagcacggcgtgcacgggcgttggcagcttatcgccaccaggcccggcaatggtgcgagccagatgcaacaccgaactgaccagcagggccaggtagacggcctgttgatcgagatcgcggacagtgctgcgcaccccccatcggcggggcgctcgccgcgccaccatggcagcgttggcgcgcacctcgatgagcccgttcagctgctgatgcagtcgatcagcggctgccatcggccagtcgggcggggcgctggtgggatcgctcaccgtgttcaccagctcggcgaggatgtcgcgcacagcggccaacacgtcggcgcgcgcactgcacagcatgaccaccgggtcgggcgggaagagcagaatgctgaacacgatagccagcccaccaccgaccagcgcgtcgaagaggcgttcgaaaaccacactgccgttggacgcgaagaccaagaccagcaccgcggagacggcggcctggttgatgaacattaagccttgcgcgaccaacccgcgtgcgcacagcaccgcgaccgacaacgcgatgaacaccaccacacccatggcgatcggtccggaaccaagcagagcatgcacgccagcacccagcacgatccccagcgccaccccgacgatcatctgttgggcacgtcgtgcgcgcagcacgttggtcgccgacatgcacaccacagccgaaatcggcgcgaagaacgcctgcggatggttgaacacgtcatgggtgagataccacgcgaggccggcgacgaccgatgtctgggtgatcggccacagcacggtgcgcaaccgttgggcgaccgcacggccgccgcaggccgtcctgactagcagcgaagcgctcatgaacgcctatttattcacactcgggtgcgacgtcgtaaccgcaaagatctggtcatgcctgctggacccgcttgggctgggcatctattccggactccttacgttgctgagcggtaatgggcgccggcgcgtcggtgagcggatcgacgccgccgccggtcttcgggaacgcgatcacctcacggatcgagtccatcccggccagcagcgcggtggtccggtcccacccgaacgcgattccgccgtgcggcggtgcgccaaacatgaacgcctccaacaggaatccgaacttttcctccgcctcggccttgtccaggcccatcaccgcgaacacccgttcctggatatcacggcggtggatacgcaccgagccgccaccgatctcgtggccgttgcagacgatgtcgtacgcgtcggccagcacgctgccggtatcggattcgatgcggtcctcccattccggtttcggcgcggtgaaggcatggtgcaccgcggtccaggcccccgagccgaccgcgacctcaccggcggcggtcgcttcgtcggccggctcgaacagcggcgggtcaacgacccagacgaatgcccacgcatcggggtcaatcaggcccagccggttggcgatctcgacgcgggccgcgcccagcagtgcccgcgacgatttgaccggaccggccgagaagaagatgcaatcgccgggtttggccccgacatggtcggccagtccggtgcgctcggcctcggtcaggtttttggccaccggaccgcccagcgtgccgtcttcggcgaccagcacgtaggccagtccgcggtggccgcgctgcttggcccagtcctgccagccgtccagcgtgcgccgcggctgcgacgccccgccaggcatcaccaccgcgcccacatacggtgcctggaagacacgaaatgtggtgtcggagaagaaatccgtgcattcgacgagctccagcccgaaccgcaggtcgggtttgtccgtaccgaatcggcgcatcgcttcggcatagccgatccgcgggatgggcgtcggaatccggtagcctatcagcgcccacagctcggtcagaacttcctcggagatcgcgatgatgtcctcggcgtcgacgaagctcatctccatatcgagctgggtgaattcgggctggcggtcggcgcggaagtcctcgtcgcggtagcagcgggcgatctggtagtagcgttccatccccgccaccatcagcagctgcttgaacagctgcgggctctgcggtagggcgtaaaacgaaccggggtgcagtcgggccggcaccaggaagtcgcgcgctccctccggggtcgagcgggtgatcgtcggcgtctcgatctcgacgaagtcgtgacgcgccagcaccgcgcgcgcagcggcattcacccgggaacgcagtcgaatcgccgcagcggggtcgtcgcggcgcagatcgaggtagcggtacttcagtcgcaactcctcacccgccggttcgtccagctgaaacggcagcggcgcacattcgcccagcacggtcaacgacgtggcgttgacctcgatctcgccggtggcgatctccgggttggcgttgccttccgggcggatctcgacgacgccggccaccgatacgcagaattccgcacgcagccggtgagcctgcgccagcacctcagtgtcctgggggtcgcggaacaccacctgtgcgatgcccgaagcgtcccgcagatcgatgaagatcacgccgccgtggtcgcggcggcgagccacccagccggccaatgtcacctgctgcccggcgtcgccttcccgtagcaaacccgcggcgtggctgcgcagcacaaacactccccttcaaccggattaaccgactgctcagtctagaggtgcccgcggcgcacatcggtcacgcaggataatttcggctcatctcaacaaacattgcaacaggcattgccctagtcggacccggtgccgtcggaacgacggtcgccgcgctgttgcacaaggccgggtattcgccgctgttgtgcggccacactccgcgcgccgggatcgagctccggcgagacggcgcagaccccatcgtggtgcccggtccggtgcacaccagtcctcgggaggttgccggcccggtcgatgtgctgatcctggcggtcaaggccactcagaacgacgccgcacgtccctggctgacccgcctgtgcgacgagcgcaccgtggtggccgtgctgcaaaacggtgtcgaacaggtcgagcaggtccagccgcattgtccgtcctcggccgtggttcccgcgatcgtgtggtgttcggccgagacccagccgcaagggtgggtgcgcttgcgcggtgaagccgcactggtcgttcccaccgggcccgcggccgagcagttcgccgggctgctgcgcggtgccggcgccacggtggactgcgaccccgacttcaccacggcggcctggcgcaaactactggtcaacgcgctggcgggatttatggtgctgtccggacggcggtcggcaatgttccgccgcgacgacgtcgcggcattgtcgcgccgctatgtcgccgaatgcctggcggtggcgcgcgctgagggtgcccgactcgatgacgacgtcgtcgacgaagtggtccgcctcgtccggtcggccccgcaggacatgggcacctcgatgctggccgaccgggcagcccaccggccactggaatgggatttgcgcaatggggtgatcgtccgcaaggcccgcgcccacggcctggccaccccgatcagcgacgtgctggtgccgctgctggcggctgccagcgacggtcccggatagcaatgtagctaatgtctagatcatgtacccctgcgagcgggtaggcctgagcttcaccgagaccgcgccttacctcttccgcaacaccgtcgacctggccatcacgcccgagcaactcttcgaagtgctcgccgacccgcaggcctggccacgctgggcaacggtgatcacaaaggtgacctggaccagtcccgaaccgttcggcgccggcaccacccgcatcgtcgagatgcgcgggggtatcgtcggcgacgaagagttcatttcgtgggagcctttcacccgcatggcatttcggttcaacgaatgctccaccagagccgtcggcgcgttcgccgaagactatcgggtgcaggccatccccggtggttgccggctgacctggaccatggcgcagaaactcgccggcccggcgcggccggcgctgttcgtcttccggcccctgctgaacctggcgctgcgccggtttctaaggaatctgcgcaggtataccgacgctcggttcgccgctgcgcagcagagttaggctggatcggccgatttcgggagcgtgcgatgaccttcaacgagggtgtgcaaatcgataccagcaccacgtcgacctcgggtagcggtggcgggcggcgcttggccatcgggggcggcctcggtgggctactggtggtggtggtcgcaatgctgctcggcgtcgatcccggtggcgtgctgagccaacaacctctcgacacccgcgaccacgtagcacccggtttcgacctgagccagtgcagaaccggggccgatgccaacaggttcgtgcagtgccgggtggtggccaccggtaactccgtggacgcggtatggaaaccgctgttgcccggctacacccgcccacacatgcggctgttcagcggccaggtaggcaccggatgcggaccggccagcagcgaggtcgggccgttctactgcccagtggacaaaacggcctacttcgacaccgacttcttccaggtgctggtcacccaattcggttccagtggcggcccattcgcggaagagtatgtggtggcccatgaatacggccatcacgtgcagaacctgctgggggtgctcggccgcgctcagcagggtgcgcaaggtgctgcgggcagtggcgtgcgcacggagttgcaggcggactgctacgccggggtgtgggcatactacgcgtccaccgtcaagcaggagagcaccggtgtgccttacctggagccgttgagcgacaaggacatccaagacgccctcgcggccgcggcagcggtgggcgacgaccgtatccaacagcagacgaccggacgcaccaaccccgagacctggacgcatggctcggccgcgcaacggcagaagtggttcactgtcggataccagactggcgaccccaacatctgcgacaccttttccgccgcggacctggggtaggcgaattaccagggacgagtcgagcactgcacgccgctgccgccgtcctgcgacaccaccacctggccgtctacaacaatctcgcagtggaactccggattgacccgcaggccgccgctggcggtgacgatcgcccactggctcgggtttgccagcgtggcggtatagaccagcggctgaccgccagcgatcggagtgtgcaaggtaatcatgtacttcgatgaatcggcattgaaagccgccatgctgggcggatcggcgctcatgtaccgaatgttggccatcaggtcgctggtggtcgtgacggtgtaggtcacctgatgcccgaccggatccgcgcgggcaatcgccgggatgaccccgctgagcgcggctccggcaaacgtcaccagcgcgacggcgcttggcactgtgcgcacggacgtcatatctaaaacgctaccggatgcgttaccgacgccggccggcactgcatgcgatgaccgtcgcccgccatccgggcaagccgaattgcgtgagccgcaccgccattagcagccgaaagctgtcgttggcctcgggcttcgcgctctggaggcgatcgctggtgtgagcgtctacgcagttcagaaagcctttccgagcaacgcgccgaggtaacttcagatttcggcagccggtttacccgcaggtaaaccagggcgggtatgaaacgtgagtgggcgccgatctgaagcagccgcaggatgccgattcacccccgaaaggggttagccgccgtaggttcctgacgacgggcgcggcagcggttgttgggacaggtgtcggcgcgggcgggaccgcgctgctgtcgtcacacccccggggtcctgccgtctggtatcaacgtggtcggagcggcgcgcctccggtgggtggtctgcacctgcagttcggccggaatgccagcaccgaaatggtggtgtcctggcataccacggacaccgtcggcaatccgcgagtcatgctgggcacgccaacctctggcttcggcagcgtcgtggtggccgagacccggtcgtaccgggatgcgaagtccaataccgaggtgcgcgtcaaccacgctcacctgaccaacctgacacccgataccgactacgtctacgccgcggtgcacgacggtacaactccggagctcgggaccgcacggaccgcaccgtcgggtcgaaaaccgctacgcttcaccagcttcggtgatcagtccactcccgcgttgggcagactggccgacgggaggtacgtcagcgacaacatcggatcccccttcgccggtgacatcacgattgcgatcgagcgtattgccccgttgttcaacctgatcaacggtgacctgtgttacgccaacctggcacaagaccgaattcgcacctggtcggactggtttgacaacaacacccgctcggcgcgctaccggccgtggatgccggcagcgggcaatcacgagaacgaagtcggtaacgggccaatcggttatgacgcctatcagacctactttgcggtacccgactcgggatccagcccgcaactgcgcgggctatggtactcgttcaccgccggctcggtgcgggtgatcagcctgcacaacgatgatgtgtgctaccaggacggtggcaactcctacgtacgcggctattcgggcggcgaacaacggcgctggctgcaagccgaactcgccaacgctcggcgcgactcggaaatcgactgggtggtcgtctgcatgcatcagaccgcgatctccaccgccgacgacaacaacggtgccgacctcggaatccggcaggaatggctaccgctgttcgaccagtaccaggtcgacctggtggtgtgcggccacgaacaccactacgagcggtcacatccgctgcgcggggccctgggcaccgatacccgaacaccgatacccgtcgacacccgcagcgacctcatcgactcaacccggggaaccgtgcacctggtaatcggtgggggcggcacgtcgaagccgaccaacgcgctgctcttcccgcagcctcggtgccaggtgataaccggcgtcggggattttgatcccgcgatccggcgtaagccgtccatattcgtgctcgaggatgcgccgtggtcggcgttccgcgaccgcgataatccttacggcttcgtggccttcgacgtcgacccgggtcaacccggcggcactacctcgatcaaggcgacgtattacgcggtgactgggccgttcgggggactcaccgtcatcgaccaattcaccttgaccaagccgcgcggcggatagctcagaacagggtcgcctgaacgggtaccagtgccgcttcggtctccggcggcgccgggcgatgatcacccgccaaccgatactttgcgatcagcggtgccacccgttcccgcagcatctcgcggtagctcggcggtagatatggcccgcgccggtacagttcgcggtaccggctgaccagttcgggatgcgcgcgggccagccagcacatgaaccagccgcgcgtcgaaccccgcagatgcaggccaaagaccgttacaccggtggcgcctgcggccgcgatctggcccaacagttggtcaaggtgctcgccggagtcggtgagttgtggcagcaccggcgcgaccatcacgtgacagtccaagccggcggcgcgaattgcggtaatgagcgccagccgcgcctgcggtgttggcgtacccgactcgacatcccggtgcagctccgggtcgccaacggccagcgacaccgccaccgacaccggcacttgttgggcggcctcggcgatcaacggcaagtcccgtcgcagcagggtgcccttggtcaggatcgacagcggcgtaccggatgccgccagcgcgccgatgatgcccggcatcagggcgtagcggccctccgcgcgctggtaggggtcggtgttggtgcccaacgcgacggtctcgcgccgccaggacggccggcgcaactcgtgacgcagcacagcggcgacgttggtcttgaccaccacctgggtgtcgaagtcggtgcccggattgaagtccaggtactcgtgggtggggcgggcgaaacaatagcgacaagcatgcgagcagccgcggtagccgttgacggtgtagcgaaacggcaacgcggccgcgttgggcaccttgttcagcgctgatttgcacaacacctcgtggaaggtgatgccgtcgaattgtggcgcgcgaacgctgcggaccaggccgatccgctgcaaccccggcagcgccccgtcgtcaacgggcatcccgttcaccgcgacggcttgccgggcccaacgcataccattattcgaacaaccgttctatactttgtcaacgctggccgctaccgagcgccgcacaggatgtgatatgccatctctgcccgcacagacaggagccaggccttatgacagcattcggcgtcgagccctacgggcagccgaagtacctagaaatcgccgggaagcgcatggcgtatatcgacgaaggcaagggtgacgccatcgtctttcagcacggcaaccccacgtcgtcttacttgtggcgcaacatcatgccgcacttggaagggctgggccggctggtggcctgcgatctgatcgggatgggcgcgtcggacaagctcagcccatcgggacccgaccgctatagctatggcgagcaacgagactttttgttcgcgctctgggatgcgctcgacctcggcgaccacgtggtactggtgctgcacgactggggctcggcgctcggcttcgactgggctaaccagcatcgcgaccgagtgcaggggatcgcgttcatggaagcgatcgtcaccccgatgacgtgggcggactggccgccggccgtgcggggtgtgttccagggtttccgatcgcctcaaggcgagccaatggcgttggagcacaacatctttgtcgaacgggtgctgcccggggcgatcctgcgacagctcagcgacgaggaaatgaaccactatcggcggccattcgtgaacggcggcgaggaccgtcgccccacgttgtcgtggccacgaaaccttccaatcgacggtgagcccgccgaggtcgtcgcgttggtcaacgagtaccggagctggctcgaggaaaccgacatgccgaaactgttcatcaacgccgagcccggcgcgatcatcaccggccgcatccgtgactatgtcaggagctggcccaaccagaccgaaatcacagtgcccggcgtgcatttcgttcaggaggacagcccagaggaaatcggtgcggccatagcacagttcgtccggcggctccggtcggcggccggcgtctgaccgcaaccgggcctcatgctaggccaccggcgaccgacggacttcccgcgcgagccgctccaaaagcctcagccgctcggggtggtcggctcgtcaaacgacagccctatcagccgagacaccacgttgtgcagcgcgtcaaacacctccaggatctcttctcggctactcgaaacccatgtttgaaacgtatgacgcccaccgacaagaatggccgccttgaggccctgcggccacggtggcgcaagtgatttcggtgactccggctggaagcggcgactacccagccagccgcgaaattacttcggccacaaccgaatccatcgagaccgaaacttgctcacccgtcgtcaagtccttcactgcgaccgtcccggcctcgatgtcgcggtcgcccgctaccaacgcaacacgggcgccggaacgagcggccgcgcgcatcgcgcctttgagcccgcgatcaccataggcaaggtcaacccgcaccccggccgcgcgcagtcgtccagccagcaccgccagcctgagcttggccgcctcgccaagcggcacgccgaacacgtcgcaccgggcgctgtcccccgccgtcttgccctcggcccgcagcgccagcacggtccggtccacgcccagcccgaacccgatgcccgacaagtcctgcccgccaagctggtgcatcaggccgtcgtagcgccccccgccgccgatccccgattgcgcaccaagcccgtcatggacgaactcgaaggcggtcttggtgtagtagtccaggccgcgcaccatgcgcgggttgatgacatagggcactccaagcgcgtccagatgggcgagcacggtgtcgaaatgctgcttggcgacatcagacagatgatccagcaacaccggcgccgacgccgtcatcgcacgcaattcgggtcgcttgtcgtcgagcacccgcagcggattgatccctgcgcgcctgcgggtgtcctcgtcgagatcgagtccaaacaagaactcctgcaacagttcccggtactgcggacggcaactctcgtctcccagggaggtgatttccagccggaacccgtcgagacccaacgagcggaacccggcgtcggcaatggcgatcacctcggcgtccaacgccgggtcgtcgacgccgatcgcctccaccccgacttgctgtaactggcgataccggccggcctgcggacgctcgtagcggaaaaacgggcccgcataacacaacttcaccggcagcgcgccgcgatccagcccgtgttcgatcaccgcacgcaccaccccggcggtgccctcgggccgcagcgtcaccgagcggtcgccacggtcggcgaacgtatacatctccttggacaccacgtcggtggattcacccacgccccgggcgaacagggcggtgtcctcgaagatgggcagctcgatgtggctatagccggcttgacgggccgccgcgagcagcccgtcgcgcaccgcgacgaactgcgccgagtcgggcgggacgtagtccggtacccccttgggggccgaaaatgacgagaattccgtcaccggctcaagccctcaaggaacggattgaagcgccgctcggccccaatggtggtggagttgccgtgcccgggcagcaccaccgtgctgtcgtcgagcaccaggagtttgtcgacgatggagcgcaacaggtcgcggccgctgccgccggccaagtcggtgcggcctatcgcacgctcgaacagggtgtcaccggtgaacacgatgtccttgtcgttgttggtcgcctgcaggacccggaagaccaccgacccgcgggtgtgacccggtgtgtgatcgatgttgaccgagatgccgccgaggtcgatcttgtcgccgtctcggtccagctccacaacctgtttaggctcacgaaagaacgcacccgcaaccagctgcgctatccgcgggcccaggccgtagatggggtcggtcagcatgaaccggtcggcgggatgcacataggtggggcagccgaaggtgtctgagaccttctgcgcggaccagatgtgatcgatgtgtccgtgggtgagcagcaccgcggcaggggtcagccggttcttgtcgaggatgcgacgcagcgtgcccatcgcaccctggcccggatcgacgatgacggcgtcggttccgggccgctcggccagcacataacagttacacgccagcaaccccgcaggaaatccggtgatcaacacggttcccagtttcccatccccggcgtccggggacgaggcgggccgcgaacatgggccacttgacaccggtcgcggcgccccgattagcctgtgctttcgtgccgaccaatgctcagcgacgtgccacagccaaacgcaaactcgaacgacaactagagcgccgcgccaagcaagccaaacgccgtcgcatcttgactatcgtcggtggctcactcgcagcggtggccgtgatcgtcgcggtagtcgtcacggtggtggtcaacaaggacgaccaccagagcaccacgtcagcaacccccaccgactcggcctcgaccagccccccgcaggccgcgaccgctcccccgctgccgccgttcaagccgtcggccaacctcggcgccaactgccagtacccgccgtcgccggacaaggccgtcaaaccggtcaagttgccccggaccggcaaggtacccaccgacccggcccaggtcagcgtgagcatggtgaccaaccagggcaacatcggtctaatgctggccaacaacgaatcgccgtgtacggtcaatagtttcgtcagcctcgcgcagcagggtttcttcaagggcaccacttgtcaccggctgaccacctcaccaatgttggcggttctgcaatgcggcgaccctaagggcgacggcacgggcggtccgggctaccagttcgccaacgaataccccaccgaccaatactcggcgaacgaccccaagttgaacgagcccgtcatctatccgcgcgggacactggccatggccaacgccggccctaataccaacagcagccagttcttcatggtctaccgggactcaaagctgccaccccaatacaccgtgttcggcacgatccaggccgacggactgaccaccctggacaagatcgccaaggccggcgtcgccggtggcggcgaagacggcaagcccgccaccgaagtcaccatcacgtcggtgctgctggattagcccgacgctcgccgagcagacacagaatcgcacgaaatcagcccgcccaatgcgattctgcgtctgctcggcggagaaaagcgcgctacgcggccgaggtcacccggtagacgtcgtagacaccttcgacgttgcggacggcgttgagcaggtgcccgaggtgcttggggtcacccatctcgaaggtgaatcgactgatcgccacccggtcccccgaagtggtgaccgacgcggacaggatattgaccttctcgtcggccagtgcgcgcgtcacatccgacagcagccggtgccggtcgagtgcctcgacctggattgccaccagaaacaccgacgacggcgacggcgcccatagcacctcgatgatgcgctcggcctgctgctgcagcgatgcggcgttggtgcagtcggtgcggtgcacactgaccccgccgccacgggtgacgaaccccataatcacatcgcccggaaccggcgtgcagcacttggccagcttggtcagcacgcccggggcgccggggacggagaccccgacatcgtcggtgctgcgtgggcgccgcggcatggtcgccggcgtggaccgctcggcgagttcctcttccgcctggtcgataccgccgagctcggccaacaaccgctgcacgacgtgtttcgccgacacgtgcccctcaccgatggcggtatagagtgctgacacgtccgcgtagtgcagctcgcgggccaccgccgccatggactcaccattgaccaagcgctgcaacggaagtccaccgcggcgcacctcgcgggccatcgcatccttaccggtctccaacgcctcctcacgccgctccttggcgaaccactggcggatcttcgtctttgcgcgcggcgacaccacgaactgctgccagtcccgcgacggcccggcgttcggcgccttggacgtgaaaacctcgacaacttctccgttttccagcttgcgttccagcgctaccaaccggccgttcactcgggcgccgatgcagcggtggcccacctctgtgtgcaccgcgtaagcgaagtccaccggcgtcgaaccggttggcagcgtgatcacgtcgcccttgggggtaaacacgaaaatctcttgcaccgcaaggtcgtagcgcaatgattccaagaactcaccggggtcggccgcctcacgttgccagtcgagcagctgacgcatccaggccatgtcgtcgatctccgcggcggcatgcggatgaagaacaccgttgcggcccttggcttctttgtagcgccaatgcgcggcgatgccgtattcggcggtgcggtgcatgtcgcgggtacggatctgcacttccagcggcttgccctcaggcccgaccacagtggtgtgcagtgactggtacacaccgtatctgggctgggcgatgtagtccttgaaccgacccgccatcggctgccatagcgaatgcactacgccgacagccgcgtagcagtcccggatttcgtcgcacaggatgcgcacaccgaccaggtcgtggatgtcgtcgaagtcgcggcccttaacgatcatcttctggtagatcgaccaatagtgcttggggcggccctccaccgtcgccttgatcttcgacgcggtcagcgtgttgacgatttcggcacgcaccttggccaggtaggtgtcccgggacggcgcgcgaccggcgaccagccggacgatctcctcgtacttcttgggatgcaggatcgcgaaggacaggtcctccaactcccacttgacgctggccatgcccagccgatgcgccaggggtgcaatgacttccaacgtctcacgggccttgcgggcctgcttctccggcggcaagaagcgcatggtgcgcatgttgtgtaaccggtcagccacctttatcaccagcacccgcggatcgcgggccatcgcggtgatcatcttgcgaatagtctcgccttcggcggcgctgcccaacaccacccgatccagcttggtcaccccgtcgacgagatggcccacctcttcgccgaattcctcggtcaacgcctccagggtgtaaccggtgtcctcgacggtgtcgtgcagcagcgcggccaccaaagtggtggtgtccatgcccaactcggccagaatgttggcaacggccaacgggtgggtgatgtagggatcaccggactgccgcaactggctggcatgcctttggtcagcgacctcgtaggctcgctgcaagatcgacaggtcggccttgggatagatctcccggtgcaccgccaccaacggctcgagcaccggattggtggtgctgcgctgggcggtcatccgccgggccaatcgggcccgcacccgacgcgacgcgctgatgctggtcttaagagtctcgaccggcgactcgggcgtctcgagagcgggctcgagagccgcagaagcctccgtgggcggtgcaaccgcttgcgccgtgagctggtcctcggccacgttcgtcacctccgacctagaggatatccctcacaggcggctcaggctgtgcaccggcagcggtgcgagcgccgcgcgaccgctcaaccccgcaagttccaccactacggccgccccggccacgttggcgccaccgcgctcaagcaggcgtcgcgtcgcgccgatggtgccgccggttgctaacacgtcgtcaatgatcacgacacggcggcccgcaacctcgatgccctcagcgagaatctccagagtggcggcgccgtacgccctgtagtactcctcgctgagcaccggccggggcagcttgccgcccttgcgaacggccagcacacccacttcgagccgggtggcgaccgcggctgccaccagaaacccgcgggcgtcgacgccggccaccaggtcagctccggacgcccgatcggccagcgcttcggttaccgcggccaatcctcttcggtcggcgaatagcggggtgaggtccttgaactcgacgccgggaaccggaaagtcggccacatcccgggtcagcgacgcaaccacgtcggccacagatatggctgagctccggcgggactcaccgagcgccaatacccgcccgtcgtcgacccaacgctgccggcggcgcttcccccgtgcctttaaggagagccccgtcgcgatcacgttcaacacgtagtcaccagcccatgtaccgccatggcacacatcctctcccagacagcccggagcacctgcgacactacgctccgataggtccgcttctcgtcgtggaattctgtcaattacctgcagatggcactggccatcgtcaccgcgccagcgcccagcgatccatgttccaccctgccccccatcgcgtcggattcctgctcaccgcatacattttcgtcgacatcaacaacgtgcgctgctgccggtacaacggcaaggttggcatctcatcccagagcaccggcgcggcctcggcaagcaacctggcccgctcggcggggtcggccgacaccgcgagcgcgctgatgatgccgtcgatctgagcgtttgcgtaccccgatagattgtttccgttgccgctgtgcaagtcataggcatccatcgcacacgatccgctcgatccgctgccggtggccccaccggtgctcgccaacaatacgtcaatctttccgtcccgcagcgcttgcggtccgggtgtgtccaccgtcacatccgaaacggtgatcccggccggggcgcaggcgtcggcaatggttccgatggtggccgccaaccgagcgttgggcctgccgtagccgatccgcacggtcagcggcgtaccacccagcgcgtcgcgagcggcggcggggtccacccggccgaactgacgtgcttcggcggcgccgtcggcatcggtgagggcatcgtcggtcgccggggacagccgcgagttggcaatcggaaccccggcatcccgagcgatcgcgtcccggggtacacacaacgcgagcgcgcggcgggtgcggctttgcgcgagtgaaccttgtggtgcgaagatcagctgctcgatcccggccgacgggtagtcggtgcgctggtagctgtcgggggttaccagggatcccgatgaaccggccgcgacgtcgaccacgtcgacgctgcggttgttgacccggtcttggatatcggctccctgcggccagacggtgatccgcttcgtgatcgccttggtgccccaccaacgatcattggcgacgagcaccacggcgccatcgtccaggacggattcgatcttgtacggtcccgacgaggggaagcggctgcggacttcgtcgtggctgcggcccggcttgaggtcccacgtggaattccacagtcgcgcaatctgttccaccgctgacacgttgttgcttagcaacgccgcggtaacatcgatgtgcagctggtcggcgatcacgtgcgacggcatcagcgacgtcgcggtgaacagctgggagtggtcaacgacactgcgatccgggatgaacgacacccgggcctttttctgccccgccgtgcactcgatgttggcgatgtcgacatagccggcctgcgtagcagcgtcgaagccgggaaagcggccggattgtgccgcccaggccaataccaggtcgtcacaggtcaccggcctgccgtcggaatagacggcgtcgtcggagatctggtagtcgaggatcaacggcgacccctccaccaccgagaccgttccgaagtcgcggtcagccaccacttggccgtcggggccgtgatagccaaacccggtgagagtccgggcgaatgcctgcgccccggccgacgcggcaccgatgacggtattggtgttgtaggtgaccagcgcgccgtcgaccacgtagtcgatctgagccgcggcgctgcccgaacacgcggtcagcgtggttgcggcgaccaacgtcgcggtaccaacgactcgcaggccggcgatgcgcgtatgacgccggcggcggggggccaccgcgcctaccgccgaccggcgttccgcttgccggtcggacgcctggtaccgacgggacgcactgggcgcgcccccggcgccggcttgctggagccctgggccgcccgcggggcggattggctgctggcctgcgtgatccccaccagcgactgttcatcagcggctgccggctgctcgccgccatccgtgctggcgtcctctgatcccgccggcgagccggagttacgccgtttgagcacccgacgggtgtggttgcgcaccaactccgtgcgctcacggagggtaaccaacagcggcgtggcgaagaagattgacgagtaggtgccgatgatgatgccgatcagctgcaccagcgccaggtctttgagagtgccgacgcccagcagccagaccgccaccaccatcagcgccaacaccggcaacacgccgatcaggctggtgttgatcgaccgcatgaacgtctggttgatcgccaggttggcctgctcggcgaaggtgcgccgggtggtgtgctggaagccatgggtgttctcctcgaccttgtcgaacacgatgacggtgtcatagagcgagaacccgagaatggtcagcaggccgatgaccgtggccggggtgacttcgaaacccaccagggaatacacgccggcggtgacggtcaggtcgaagagcatggccgttatcgccgagatggtcatgtagcgctcgtagcgcacggtaatgtagagggcgaccagcaccagaaacaccaccagcgcgatcaccgccttcttggtgatctgaccgccccaggtctccgacaccgccgagtcgctgatggcctgcttgctgggctgaccgtcggttcccttgggcccgaaggcctcgaatagggcgtcccgcagcttggccgtctggtcgctggtcagcgtctccgaacgaatctgcaccgtcgccgaagcaccggccccgacgatcaccaccgactggggctcactgccgagggcccggtagtagacgtcttcgacctgcgcgacttgggtgctgccacgcgggaacgacaccgtggtaccgcctttgaaatcgatgccgaaggtgaacccacgaaagacgatgctggcgatggccaccgcgacgatcgcaccgctcacgccaaaccacaaccggcggcgtcccactacctcaaacgccccggtgccggtgtacaggcgcgaaaggaagctatggtgccccagcttcgaggcggtgtctgtggtgctgtcgccgtcggtccgcgccacagcactctcggtggcctcggtgagttcgaccgccgacgtggcttcgtcgtcgcggccggtctttgctttcgacgccatcggctatccccgtcccgtccgagccatggcccggcgttcgcgtgcgacctgctgcaccgctcccaggccgttgtatgccggcttggccagcagcgacgatttggacgccagatacaccaacggccacgtcaccaagaacaccacgacgaggtccaggatcgtggtgaggcccagggtgaacgcgaaccccttcacctgaccgatcgccagaaagtacagcacggcagcggccaggaaagtgacggcgttgcccgacacgatcgtcttgcgggcacgcgcccaaccgcgcggcactgccgaccggaacgaacggccttcgcggatctcgtctttgatgcgttcgaagaacaccacgaacgagtcggcggtggtcccgataccgatgatcaggcccgcaataccagccagatctagggtgtagttgatatatcggcccaagagcaccaggatcgcaaaaaccattgagccagaagccactagcgacaaggccgtgagcagtcccagcactcggtagtagagcagcgaatacaccagcaccaacagcaggccgatcgcacccgcgatcatgcccgcgcgcagcgatgacaaccccaaggtcgccgaaaccgtttgggcttccgacggttcgaaggacagcggcagcgacccgtacttgaggacgttggcgagctggcgtgcggtcgccgcggtgaatggcggatccccaccgctgatctgggttcggccgccggggatcgcttcctggatctgcggtgcactgacaacctgcgagtccagggtgaacgccgtctgggtgccgatatgggcggcggtgtagtcggcccagatgttggccgccggacccttgaactgcaggtcgacgacgtagccgatgccgcgctggtccatacccgaggtggcgttttggatctggtcgccgctgatgatcgacggcgccagcaggtacgcggtcttgtggtcggtcgagcaggtcaccaacggcagtttcgggtcgtcgttgccggccaaaatgtcgtcgctctcgcagcgggtcgcctggaattgcagtgcaaccatctgcatgtattggttggtgctctgccgcagcttcttctcctgggcgatgcgctcggcgagatccttgcgcggatccgtggccggcgcctcagcgggcggcgccggcggcgggctggccggtgaggtcgggttgggcgatggcgccgggtcctgcggatagggccgcggttgggccccaggttgcggtgaagccggcgcccccgattgggctggcggcggtgcggcgggttgaccgggcggctgcggttcggcgctgggtgccggctgcggttcttcggctgcgggctgcgccggcatcgagttgagcaccggccggatgtacagccgagcggtctgtccgaggttgcgtgcctcgctgccgtcgttgccgggcaccgtgatgaccaggttgtcaccgtcgacgaccacctccgacccggacactcccagcccgttgacccgcgcgctgatgatttgctgcgcctgtgccagcgcttcccggctcggggccgagccgtccggtgtgcgcgcggtcagcgtgaccctggtgccgccctgcaggtcaatgccgagtttgggggcggtgtgcttgtccccggtgaaaaacaccagcaaatagatgccgatcagcatcaccaggaacaccgacaggtaacgggcagggtgcaccggcgccgaagacgatgccacgttccttgtatctcctcgagaatcagttttctacccccgacagagcctacgtgtcgcgccggggcgcgtcgcgcaagcggctcgtcggttccggtcggccggttgccggtcaggaatcgttggtcacccggcgctcgccggccacgtcgtcaacatccttgtcaaggtcctcgttgagctcctcgtcgatgtcgtcgtccggcagaattcggtcacgaatcgccaacttcatccacgtggtgaccaccccgggcgcgatctcgaggtcgatggtgtcgtcggcaatggcgacgatggtggcttccagcccagaagtcgtgtgtacccgctccccgggctgcaacgagtcgtgcagatcgatggtggcttgcatggcccgtcgctggcggcgcgacgcgaagtacatgaacccacccatgatgagcaggaacggcaagaacaaaacgaaactctccatcaacccgtctttcgtattggtattgcgatcacggtgccaggcctacccgcgggccgcgcacctggtaacagtccagtgtgcccgtccagtctggcaggccggaaacatcggtcagcagataggctttaccagcgatgtgaaccggcgagccgggtgaggaggatctgtggccagcctgcagcagagtcggcgcctggtcaccgaaatccccggtcccgcatcgcaggcactgactcaccgccgggcggcggcggtgtccagcggtgttggggtcaccctgccggtgttcgtagcccgcgccggcggcggcatcgtggaagacgtggacggtaaccggctcatcgacctgggttcgggcatcgcagtgacgacgatcggcaactcgtcgccacgcgtggtggatgcggtgcgcacgcaggtggccgaatttacccacacctgcttcatggtgacgccatacgaggggtacgtggccgtcgccgagcaactcaaccggattaccccaggttcgggccccaagcgctcggtgttgttcaattccggcgccgaggcagtcgagaacgccgtcaagatcgcacgctcctacaccggcaagcccgcggtggtggcgttcgaccacgcctaccacggtcgcaccaacctaacgatggcgctgaccgccaagtcgatgccctacaagagcggcttcggtccgttcgcgccggagatctaccgagcgccattgtcttacccctatcgggacggcctcctcgataagcaactggctaccaatggtgagctagccgcggcccgagccatcggcgtcatcgacaagcaggtaggcgcgaacaacctggccgccctcgtcatcgaaccgatccagggcgaaggcggtttcatcgttccggccgaagggttcctacctgccctcctcgattggtgccgcaagaaccatgtggtgttcatcgccgacgaggtgcaaaccggctttgcccgtaccggggcgatgttcgcctgcgagcacgagggccccgacggtctagagcccgacctgatctgcacggccaaaggcatcgccgatggattgccgctgtcggcggtcaccggccgcgccgagatcatgaacgccccgcacgtgggcggcctgggcggcacgttcggcggcaacccggtggcctgtgcggccgcgctggccaccatcgcaaccatcgaaagcgacgggctgatcgagcgggcccgccagatcgaacgcctggtgaccgaccggttgacgacgctgcaggccgtcgacgaccggatcggcgacgtgcgtggtcgcggcgccatgatcgccgtagagctggtcaaatccggaaccaccgagcccgacgccgggctgaccgagcggctggcgaccgcggcccacgccgccggcgtcatcattttgacctgcggcatgttcggcaacatcatccggctactgccgccgctgaccatcggcgacgagctgctgagtgaggggctggacatcgtgtgcgcgatcttggccgacctctgacggcctgccggccccgactgcgtcatcccgtgccgcatctcacagccgatcagcagcaggcttgcattgtgtaatatatttactttagctaacgttctattggtcgggcgcagcgccgcgccgtcgatttcccaccctttccggcacgccgaggtgaccgcatgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtgatcgggcctggccgccgcggcgccgggtaaccaagcagcccgttacgcccagttcgcctatgagaaggcagtaagaagcgcgaaaaatggcagaccccgacggaggccctctgaaagagtcttgatcatcagggcgcgtgacatgtgtcacatgacgggttgggagggtggctgatgtcgtttgtcacggcagctccagagatgctggcgacggcggcgcagaatgtcgcgaatatcggcacatcgctgagtgcggcaaacgcgacggcagcggcgtccacgacctcggtgctggcggccggagccgacgaggtatcgcaggctatcgcaaggctgttcagtgattacgccacgcactatcagtcgctgaacgctcaagccgcggcatttcatcacagcttcgtgcaaacgttgaacgccgccggtggcgcctattcgagcgccgaggcggccaacgcttcggcgcaggcgttggaacagaatctgttggccgtgatcaatgcgcccgcccaggcgttgttcgggcgtcccctgatcggcaatggcgcgaatggaacagcggccagccccaacggcggtgatggtgggattttgtacggcaacggcggcaacggcttctcccaaacgaccgccggggtggccggcggcgccggtggttccgcgggcctgatcggcaacggcggcaatggtggcgccggtggggccggtgctgccggcggggccggcggcgccggcggatggctgctcggcaacggtggcgccggcggtcccggcggcccaacggacgttcctgccggcacaggtggagccggcggggccggcggcgacgccccattgatcggctggggcggcaacggcgggcccggcggtttcgctgcttttggaaacggtggggccggcggcaacggcggcgccagcggttcgctctttggcgtcggcggcgccggcggcgtcggcggatcgagcgaagacgtcggcggcaccggcggggccggcggcgctggccgcggtctattccttggcctgggcggtgatggcggcgccggcggcaccagcaacaacaacggcggtgacggtggcgccggcggcaccgcgggaggtcgattgttcagcctgggcggtgacggtggcaacggtggtgccggtaccgcaatcggatccaacgccggtgacggtggcgccggcggtgacagcagcgccctgatcggctacgcccagggcggctccggcggcctcggcggcttcggcgaaagtaccggcggcgacggcggcctgggcggcgccggcgctgtgctcatcggcacgggcgtcggcggtttcggcggcctcggtggcggctccaacggcaccgggggcgcgggcggcgcgggcggcacgggcgccacgctgatcggcctgggcgccggcggcggcggcggcatcggcgggttcgccgtcaacgtgggcaacggcgtcggcggtctgggcggccagggcggccagggcgccgcgctgatcggcctgggcgccggcggtgccggcggtgccggcggcgccacagtcgttggacttggtggcaatggcggtgacggcggtgacggtggcggcctgtttagtatcggcgtcggtggggacggcggcaacgccggcaacggcgccatgcctgccaatggcggcaacggcggcaacgccggggtcattgccaacggctcctttgccccgtcgttcgtcggcttcggcggcaacggcggcaacggcgtcaatggcggcaccggcggcagcggcgggatcctttttggcgccaacggcgcgaacggaccgtcgtagcgggtcctccagcgcactactcgaacaaccccggttgactcgctccgaccggtggcgtcatgcccaggtgcgtccaggccagggcggtggccacccggccgcgcggggtgcgcgcgaccatacccgcgcgcaccagaaatggttcgcacacctcctcgaccgtggcggcctcctccccgaccgccaccgccagcgtcgacacacccactggaccaccgccgaagctgcgggtcagcgccgagagcaccgctcggtccagccggtccagacccagctcgtcgacgtcgtagacctccagtgcggccttggcgacgtcgcgggtgatgacgccgtcggcgcgcacctcggcgaagtcacgcacccggcgcaacaaccggttggcgatccgcggcgttccccgagaacggcgggcgatttcggcgccggcgtcggcgcccagctcgatacccagaattccggcggagcgggccagcacccgctccagctcggcgggctcgtagaaatccatgtgcgcggtgaagccgaaccggtcgcgcagcgggccggtcaacgcgcccgaccgggtagtcgccccgaccagggtgaacggcgcgacctccagcggaatcgacgtggccccaggacctttgccgaccaccacatcgacgcggaagtcttccatcgccagatacagcatctcctcggcgggccgggcgatgcggtggatctcgtcgataaacaacacgtcgtgctcgaccaggttggacagcatcgccgccaggtcaccggcgcgttccaacgccggccccgacgtcacccgcagcgaggaccccagctcggcggcgatgatcatcgccaacgacgtcttgcccaagcccggcggaccggacagcagaatgtgatccggtgtgccgccgcggtttttggctccctcgatgaccagctgcagctgttcgcggacccggggctggccgatgaattcgcgtaacgagcgcggccgcaggctgacgtcgatgtcgccctctccgacggtgagtgcgggcgaaacgtcgcggtcggaccgctcggtcatcgggccttccccagcaacgacaaggcagaccgcagcgcgctggatgtcgtcgcgtcatggttggcggccagcaccgtatcggtggcctcctcggcctgtttggccgcaaagcccaggccgaccagagcctcgaccacgggactgcgcaccgcgtggccgttggtcgagagtgcgccgccggtggctgccaccccaaccttgtcgcgtagttccaacaccatgcgttcggcgccccgcttgccgatcccaggcacccgggtcagggcggcgacgttgccgtcggccagcacctgccgtagcgccggagcgtcgtgcacggccagtgccgccatcgccagccggggcccaacgccggagaccgacagcagcgtcaggaataggtcgcgggtttccccgtcgggaaacccgtacagcgtcatcgagtcctcgcgcacaatcatcgcggtgatcagccgggcctcggtgccttgccgcaacgtcgccagcgtcgccggtgtcgcgttcactcggtagcccacaccggcggcctcgatcaccacatggtcaagcgccacctcgagcacctcaccgcggaccgaggcgatcatcgggcggccttcagcttggctaggtacgcatgacgctgctgcgctgctcgtgcttccgccctcgacgtggcctcagccatccgggcgatcgtcggcgcccgccaacagtgacagatcgccagcgccaaagcgtcggccgcgtcggccggtgtcggtttagcttgcagcgcaaggattttggtgaccatcgcggtgacctgagccttgtctgcggaaccgttgccagtgaccgccgccttgacctcgctgggggtatggaaatgcacgtcgacaccacgtttggccgccgccagggcgatcacgccgccggcctgcgcggtgcccatcaccgtggtcacgttgagctgagagaacacccgttcgatagccaccacctccggatgatgggtgtccagccagtgctcgacggcatcgctgatggccaacaggcgctgcgccaaggccgcatccgacggtgtgcgcaccacgtcgacatccagcgcggtgagctgccgaccacgcccactctcgataagcgacagcccgcatcgggtcaacccgggatcgacacccatcacccgcaccgcacgctccctcagccatttccgaacaatcgttcgatacgctagcggatcgtcccgacatcccgcgcaggacacgcctatggaacgtgcgatggtaaatttcctaccatgcgaacaaccatcgatgtcgcaggacgtctggtgattcccaagcggattcgcgagcgccttggcttgcgcgggaacgaccaggtggagatcaccgagcgcgatgggcgcatcgagattgagccggccccgaccggtgtcgaactcgttcgggaaggctcggttctcgtcgcacggccagaacgtcccctgcccccgttgaccgacgaaatcgttcgggaaacgctcgatcgcacacggcggtgatcgcaccagacaccagcgtgctggttgccggattcgcgacctggcacgaagggcacgaggccgccgtgcgcgcgctcaaccgtggcgtccatctgatcgcgcacgcggctgtggaaacctattcggtcttgacccggctaccaccgccgcatcgtattgcccctgttgccgtccacgcctacttggcggacatcacctccagcaactacctggcactggatgcctgctcatatcgcggcttgaccgaccacctcgccgagcacgatgtcaccggtggcgcaacctacgatgccctggtcggcttcacggcgaaagctgccggcgcaaagctgctgactcgcgacctgcgcgcggtcgaaacgtacgagcgattgcgggtcgaggttgagctggtgacctgagaaaccgttgccgttgagtgtgtttgagttgcacgctcaccgacacccggatggtgcaccagtgagctggggtgaccgcggccgagacctgccgggttcccggccggacaactcgcccgttgtgacccccggtcccgcgaaagctgttacgttaaacggcgccatcgatatgcgaccgatcgaccaaccgcggcgcagcggtacgagagggtatgcgtgggaaatctgctggtcgtgattgccgtggcgctgttcatcgccgccatcgtcgttctcgtcgtggccatccggcggcccaaaacaccagccacgccgggcgggcgccgggatccgctggccttcgacgcaatgccgcaattcggcccccgccaactcggacccggcgcaattgtcagccacggtggcatcgactatgtggtccgcggatcagtcacctttcgcgagggtcccttcgtgtggtgggaacacttgctggaaggcggcgacacgccaacctggctgagcgtgcaagaggacgacgggcgtctcgagcttgcgatgtgggtgaaacgcaccgatctgggcttgcagcccggtggccagcacgtgatcgacggcgtgacgtttcaggagaccgagcgcggtcacgccggatataccaccgagggcacgacgggcctgccggccggcggtgagatggactacgtcgactgcgccagtgccggtcagggggccgacgagtccatgctgctgtcattcgagcgctgggcaccggacatgggatgggagatagcgaccggcaagtccgtactggccggcgagctcaccgtctaccccgcgcccccagtctcggcatagggccgaatcggtgccacttcatcagctcgccatagcgccggtggacgtatcaggggcattgcttggactcgtgctgaacgcacccgcgccgcggccactggccacccaccgactggcccacaccgacggcagcgcactgcagctcggcgtcctcggcgcgtcgcatgtcgtcaccgtcgagggacgcttctgcgaggaagtctcctgcgtggcccgcagccggggcggcgatctgcccgagtccacccacgcacccggctaccacctccaatcccataccgagacgcacgacgaggcggcgtttcggcgactcgcgcgccacctgcgtgaacgctgcacgcgggcaaccgggtggctgggcggtgtgtttcccggtgatgacgccgcgctgaccgcactcgccgccgaacccgatggaaccgggtggcgttggcggacttggcatctgtacccgagcgcgtccggcgggacggtggtccacacgacgagccgatggcgtccatgagccgcaaccgcctgttcctggttgccggcagcttggcggttgccgccgccgtgtccttgatctctggaatcacgctgctgaacagggacgttggctcgtatatcgcctcgcactatcgccaagaatcccgtgacgtgaacggaacgcgatacctgtgcaccggatcgcccaaacaggtggccaccacgctcgtcaagtaccagaccccggcggcgcgcgcgtcgcataccgacaccgagtacctgcgttaccgcaacaacatcgtgacggtcggacccgacggcacctatccgtgcatcatccgcgtcgaaaacctcagcgccggatataaccacggcgcatatgtcttcctgggccctggattcacccctgggtccccgtcgggcggttcggggggcagcccgggcggtcctggcggcagcaagtaaggcgatgacgcaaaggagagagtcatgtattaggccggagtcgatttcgggaccatcagccttaccccgatcctgcatggggtggtggccaccgtcttgtacttcctagtgggcgccgccgtgctagtcgcaggctttctgatggtcaacctgttgaccccgggcgatctgcgtcgcctagtgttcatcgaccgccgccccaacgccgtggttctggccgccacaatgtatgtggcgctggccatcgtcaccatcgccgccatctacgccagctccaatcagctggcccagggcctgatcggcgtggcggtgtacggaatcgtcggtgtcgcgctgcagggggtggcactggtgatcctcgagatcgcggtgccggggcgattccgtgagcacatcgacgcacctgcgctgcatccggcggtgttcgctaccgccgtcatgctgctggcggtagcgggggtaatcgccgccgcgttgtcatgacgtccacccggcaggcgggcgaagccaccga

SEQ ID NO: 648 - DNA, 86114 bp, Mycobacterium tuberculosis
aagctttgcggacttgctcgaccgacattgcgtgccattcatgagcgggtgccggtcgcggtgcttgcgcgtcgacgaccttgcgtgccagcaggtatcccgagagcagtccggccgccgcgccggtggtcaccgggccgggccccagtccgcggacccctggcagcatcaacagggctcccaaagccgatgcaccaccggaaatttcgttacctcgctggcgtgcggccctggccgccggaatcgcgtgcagcaccctccaggcggctccaagatcgggcagcaggacatctgcgtaccagggcggtgcaccggctccaggtggtggcagcacaccaagcgccacatcggcagccgaaagcgcttgcttaccaaccgatgacaacaccgcgacggtgcggcccgcctggcgcagctcggccaccgcacgggctagggcttcgtcgagggacccgctggcaccgtcgtcgaggggccggatgtcgtcgaacaccggtcgcaactcgcccagggcgtcgacatcgaccgaaaccaggtccgccccggtgcgatgtgcctcggcaaccaccgcggaggccagccggtcgtgcatggggcggaaaagtgcctcgactgccgaatccgaaccgctggccgagacaccgggtactcggtgccagcctgggcgcaggccactctccgtcaaaacgagttgcgcccgattccacgctgtggacagctcgtctgcgccgcaaccgcggatgcgcgccacgcgcaggtcatcggtgcacagcacgcgggggtcgatgacgatcgcatcgacccgatccaatcggcgcaaactctccggccgtaacggcaacaccgcgtgctgatcagccaaaccttggccgagcgccgcggcgaacgcctccggcgtggtccggctggctttgggggtggccaccagcgtcgcggtcgcggccatgtccgcgtcgcgggtcccggcgcccacgagcaccgcgctcagcgcttggatcagcgcgaaacgcgcgacgctgcgttggacaggttgcgtcgaccgtgcgggacgcggccaaagggattggggttggtcggccggttcgtcggcgtgcagcgcgagctgtggttcatgccggcgccaggctctggctccggcacggcattccgcggctttcagcgcctggatcgtcagatccaccgacaacgccgccggcgacagcgtgaccgtgtgtgcggcggccatggccagctcaaggacggtggcggtcgcctccgtgcctattcgatcctcgagtaggcggcgcagcaacggctggtggtccacggccgccaccgctgcctcgatgacgagcggaaatcggggccagcgcagcgcccggccgccgagcgctaagcccagcccggccgcggtggcggctaccgttacagctctgaccgccagcagcacgccgtcgcccggcaggctccccggtgattgcgccagctgatcggcggcttgatctgggtggcggtgtctttcggctttttcggcgtcatcgacaatgcggcaaagttcgcgcagtgatgtgtcgggatcgtcgatagcgacgacgacacgggacaacgggtagttcaggctggccgacccgaccccggggtgggcttggattgcgttgagcacgacgcgcccaagttcgtcgtcgcctccgctgcgcaagccgcgcacttcgatccaggcgcgacgctcgccacgccaacagttccggccgagtgtctcgcgggacagctcgccggaaagtgccttggctcctgcgcgcagcgggatgatggcgaccttcataccggttccgaccccggtcttggccagggttgccgagaccgctgtcgcggcagtgatcgatgcgccggtaagggtggcggtcgcccggaagcccgtggcgacagcacgcaccggcatagcccgtgcgatggatgcagcaatgctcaagagttgctcaacgccgccagactagttggtgctgcgcagctcagcggtgcccgctcggcgaccgctcgtcttcctggctgttgtcttgctcgctttggctggcgcttcctttgcggcagccggcttgtcgggcaccggcgcaagtttcgccttcaccggcggtgcggccacctcgggggtgcggttgagcttccgcaatagcaacgctccgccgcccacggccaacaggatcggccaatcgacgagtccagcgacaccgatcgcaccgatggccaacgcggctgccgcggtcgacttgctgccgctgctaagccccttctgaatgcctttggcggctccggtcacaccgccgacgatgccgctcacggcggcgccacccaccgcacccgcggccgctgtggtcgccgttgctgcaccactcaccgttcgccccacggttcgaactgtcccgccgaccacactcatgatgactccctggcccaaactgcattcgtttacaaatggtttagctacagttctacactcgttaacccgcaccctgcattcgcaccgctgacgagatttctgttcagcgctctcgaaatgcaagcctgccacgccgccctgactgagacaacgcgcaactgccgcgtgcggcgcgactgccgactaccgccgtacgccgcctacccggcgtgcaggtcgacgagcaccggagcgtggtcgctgggcgctttgcctttacgctcctcgcgtacgatctgggcgtccatcacccgggcggccaacgccggcgagccgaggatgaagtcgatgcgcatgccctgtttcttcgggaaccgcagctgcgtgtaatcccagtaggtgtaaaccccgggtcccggggtgaaaggccgtactacatcggtgaattgcgcgtcgacaatggcgttgaacgccttgcgctcgggttcggaaacgtgcgtgcagccggcgaagaattcggtgctccagacatcatcatcggtcggagcgatgttccagtcgcccatcagtgcgattggtgcggcgggatcgtcacgtagccagccttcggccgtatcacgcagcgcggcaagccaatccaacttgtaggtgtagtgcggatcgtccagggcgcgcccgttgggcacgtagaggctccacacccggatgccgccgcaggtggcgcccagggcacgggcctccgtcgtggcggccacttccggcttgccgctccagctgggctggccgtcgaacccaacccgcacgtcgtcgaggccgacgcgggatgcgatcgccacgccgttccactgatcgaagccgacgtgtgcgacgtcatagccgagttcgaacagcggcaaggccgggaattggccgtccgggcacttggtctcctgcatggccaacacgtcgacatcggcgcgcccaagccaatcgaggacacgatccaaccgggtgcgaatcgaattcacattccaggtggccagccgcagcagcggcgatcgcaagcgcggcgaagccgggcgttgggggtggccgccgtcaattgtgccgtcgggcatggctagaaggtatcccagccgaccgactgggcaggaagatagcggcagtgatggtgcagccggaagcccagggactcggcgaggacggatgtcgcggtgtcgtgcacgcgcacgtagccgcgggtcgcgccgcggcccgctccccagcccaacagcgcttcccacaattggcggccagcggagccggtcgcggattgctcgtcggcggcacgcattgccgacagacccacccaccgggtgccgtcgggtgcgtcggttaccgctgcacgtgcgaccgccacacccaggtagctgccgaatgccaactcgccgtcgatgacgggggtcgccatgtcgaggggtaggcgttggtggtagagccgcagccaggtgtcgtcggggtggtccagcaacgtgaccgaccggtcgggttcaccggtggacacgtcacgcaccaacacttgctctcggcgctcacctgccaggtcggccggtagtggcagcaagcggtccgggacggccagccatggctgcagatcacggctcgcataccatgcgctgatttctgtgatggtgttcgtgtgtgccgagatatccagcggtactgctgaattagcggccagtacggccccgtgtccggctcgcaggagccagccgtccagccaggttcgttcaacgccgggccaggccgccgcggcggcgtgttcaagtgcgcggatcgcggcggtgcgcaccggcgcatcggtcaggacccgcagggccaccacatcgacgggcgagaactcgacgatggtcccggtcttggtctgcactcgcaccgtcggatcgacggctagcagccgacccaccgcatcggtcagcggtggcatcgatccggcgggccggcggtagcgcaccgttacccgtgtcccaagccccggccacgagaccattagtgaccgaacgggtcggggtcctcgccgggcagccacgacagtccgggaacgccccagccatgtgacttgacggcccgtttggcgttgcgggcgtaccggccgatgaggcggtccaggtacaggaatccatcaaggtgcccggtttcgtgctgcagcatccgcgcgaacaggccggtgccctcgatactgaccggactgccatcggcgtcgagtccggtgactcgtgcccacttcgcgcgtccggtaggaaatgactcgccgggaaccgacagacagccttcgtcgtcggtgtccgggtcgggcatggtctcaggtatttcggaggtctcaagcaccggattgatgaccacaccgcgtcggcgggcggtcattgcgcggtccgcggcgcaatcgtagacgaagagccgcaggctgcagccgatctggttggcagccaggccgactccgttggcggcgtccatggtgtcgtacatggtggcgatcaactgggcgagatccgccgggagtgaaccgtcggcggcgaccgtcaccggtgtggtcgcagtgtgtaagacgggatcgcccacgatgcggatgggtacgactgccatggtgggctagcttaagcgcgccgacgatacgcgccgcgaggcggcgggctgaggaggcgggcaatcggcttaggcgcgccgcggggcggcgggcatcatcgccgggtgtgaaccacacgacggctggccggcatgtcgcgtcgcaggattcacactcggagcatgagccggcgcgccgcgatcggcagtcgggtgcaagcaagtcggccgactcgcgggcaggattaccgcccgacggttcctggcgtggttcaatattcgccgaagaagcgcctacgtaggccaagtcattcgtacacattgagaattcgccggaagggcccaggggaaagcgatatggacagcgccatggcgcgggcaattcgatcgggggacgacgccgaggtcgccgatgggctgacccggcgcgagcacgacatcctggcgttcgaacgtcagtggtggaagtttgccggtgtcaaggaagaagccatcaaagagttgttctccatgtcggcgacgcgctactaccaagtgctcaatgcgctggtggatcggcccgaggcgctggccgccgacccgatgctggtaaagcggttgcggcggctgcgcgccagtcggcagaaggcgcgggccgcgcgacgccttggcttcgaggtgacctgacactctccccgcttttgccggttgtgtcccggtgctggttacagtgggctcgatgaatgagcgtgtacccgactcttccgggcttcccctgcgggccatggtgatggtgctgttgtttctcggcgtcgtcttcctgctgctcgtctggcaggcactgggttcgtctccgaactccgaggacgactcgtcagcgatttccaccatgaccaccaccactgcggcgccgacgtcgaccagcgttaagcccgcggcgccccgggccgaggtgcgcgtctacaacatctcaggcacagaaggcgccgccgcgcggacggccgatcggctcaaggcggccggtttcacggtcaccgacgttgggaatctatcgttacccgacgtcgcggcgaccacggtgtactacaccgaagtcgaaggcgaacgggccaccgccgacgcggtaggccggacgctaggagcagcggtggagctgcgactgccagagctgtccgaccagccgcccggggtcatcgtcgtggtgaccggctgacgctgattcgaacgccaggttaggctctcgctatgccaaagcccgccgatcaccgcaatcacgcagctgtcagcacgtcggtcctgtccgcgttgtttctgggcgccggtgccgcgctgctgagcgcatgctcgtcgccgcagcacgcgtctacagttccgggtaccacgccgtcgatttggaccggatcgcccgcgccgtcgggactttcgggtcacgacgaggagtcgcccggtgcgcagagcctgaccagtaccctgacggcgcccgacggcacgaaggtagcgaccgcgaagttcgagttcgccaacggctatgccaccgtcacgatcgcgacgaccggcgtcggtaagctcacgcccggcttccacggcctacacatccaccaggtgggtaagtgtgagcccaactcggttgcccccaccggcggtgcgcccggcaactttctgtccgccggcggccactaccacgtgccagggcataccggcacccccgccagcggcgacctggcctcgctgcaggtacgcggtgacggttcggcgatgctggtgaccaccaccgacgccttcaccatggacgacctgctgagcggcgcgaaaaccgcgatcatcattcacgccggcgccgacaactttgccaacattccgccagaacgctacgtccaggtcaatgggactccgggtcccgacgagacgacgttgaccaccggcgacgccggcaagcgggtggcgtgcggtgtcattggttccggctagcttgcctgcccgcaggtcggccgcccgaattgatttcgcaggctcaccgcggcccaccctcggtgtggagtgggagttcgcgctcgttgactcgcagacccgcgatctgagcaatgaagccaccgcggttatcgccgaaatcggcgaaaacccgcgggtccacaaggaattgctgcgcaacaccgtagagattgtcagcggtatctgcgaatgtaccgccgaggcaatgcaggatctgcgcgataccctgggccccgcccgtcagatcgtgcgcgaccgcgggatggagctgttctgcgcgggtacccaccccttcgcgcggtggtcggcccagaagctcaccgacgcgccgcggtacgcggagctgatcaaacgcacccagtggtggggccggcagatgctgatctggggtgtacacgtgcatgtcgggattcgctcggcgcacaaagtgatgccgatcatgacgtcgctgctcaactactacccgcatctgttggcgctctcggcctcatcaccctggtggggtggcgaagacaccgggtatgccagcaaccgggcgatgatgttccagcagttgcccaccgccgggctgccgtttcactttcagaggtgggcggagttcgaaggtttcgtgtacgaccagaagaagaccggcatcatcgaccatatggacgaaatccgttgggatataagaccctcaccccatctgggcaccctggaggtgcggatctgcgatggcgtgtccaacctacgagagctcggcgcgctggtcgcgctgacgcattgcctgatcgtcgatctggaccgccgcttggacgccggcgaaacgctaccgaccatgcctccctggcacgtccaggagaacaagtggcgtgccgcccgctacggcctggacgcggtgatcatcttggacgccgacagcaacgaacggctggttaccgatgacctcgcggatgtgctgacccggctggagccggtcgccaagtcgctgaactgtgccgacgagcttgccgcggtctccgatatctaccgcgatggcgcctcctaccagcggcagctgcgagtggcgcagcagcatgacggcgatttgcgcgcggtagttgacgcgctggttgccgagctggtgatttagccgatgcgggctggctgagtgtgacgtccgccagccgcgaggagattgaggtttaggtgatggccgatttcgcgccggttgagttggcgatgttcccgctcgagtcggcgccgctgcccgacgaagatctgccgttgcacatctttgagccccgctacgcggcgctggtccgtgactgcatggacaccgcggatcctcgcttcggtgttgtactgatctcgcgtggccgcgaggtcggcggcggcgatacgcgatgtgatgtcgggacgctggccaggatcaccgaatgcgcggacgcgggttcgggtcgctatatgctgcgctgccgggtgggcgaacggatccgggtgtgcgactggctgcccgacgatccgtacccgcgtgcgaaggtacggttctggcccgaccagccggggcacccagtgacggctgcccagctgctggaagtcgaagaccgggttgtggcgctattcgagcggatcgctgccgcccggggagttcggctgccggcccgtgaggtggtattgggctacccggtggttgacccagccgataccgggcagcgtctgtacgcgctggcatgtcgagtgccgatgggcccggccgatcggtacgccgtgctggcgacgccgtcggcggccgatcgattggtccgcttgggtgacgcgctggactcggtggccgcgatggtggagttcgagttgtcgacgtaactgccctacgcggtgcgtctgacccactgggcctgaaccacattcactgcgccgagcaccatatacggacccgtcaccgccggcaagcgcatccgggtgcggaaccggctcgacaatggtcaacgccttcgcaccattgccgaccagtacccgcaattgctcgacttcatcagtggtcgctaggaccgaaggtcacccttggtgccgaacttacgcagcgacgccacctgcagcggatccagcgacgcgcgcacggtttctcgcgcggtcgccaggtcggcggcggtgacgttggcggcatcgatggaacgccgcatcgcggtaagcgcggcttcgcgcagcagcgccacacagtcggcggcactataaccgtcgagtccggctgccacctcgtccaggtcgacgtcggagctcagcgggatcgacttgccagcggtgcgcaggatttcgcggcgagcggcagcgtcgggcggttcaacgaacaccagccgttctagccgccccgggcgcagcagcgccgggtctatcagatcgggccggttggtcgcgcctagcatgacgacatcccgcagcgggtcaataccgtcgagctcagtcagcagcgcggccaccacccggtcggagacgcccgagtcgaagctctgaccgcgccgtggcgccagagcgtccagctcgtcgaggaacaccagtgacggcgcggagtcgcgggcccgccggaatagctcgcggactgccttctccgaggagcccacccacttgtccatcagctccgaccctttgacggcatgcacgctcaactgtccggtgctggccagggcacgaaccacaaaggtcttgccgcagccgggcgggccgtacagcaacaccccgcgcggcggttcgacacctagccgagcgaaggtgtcggggtgctgcagcggccacagcaccgcctcggtcagtgcttgtttggccgcggccatgtcaccgacatcgtcgagcgtcacgtcacccacggtgacttcgtcgctggccgagcgggacagcggccggatgacggtcaacgcaccgaggaggtcgtcttggtgcagcatcggtggtcggccgtcggcactggctcgagacgctgcccgcagcgccgcctcgcgaaccagcgcagccaggtcggccacgacgaaacccggtgtgcgggaggcgatttcgtcgaggttgaggtctccggtaggaaccggattcagcagcgcctccagcagcgatttgcgggtggccgcgtcgggcagcggcaggccaagctcccggtcgcacaactcgggggaacgcagccgggcatcgagttgatcgggccgtgctgaggtggcgatcaataccacaccggcggtggccaccgcggtacgcagctcggacaggatcagcgaggctaccggctcggcggcggctggcagcagggcgtcggcatcggtgatcagcaacacaccgccctcatggcgaaccgcctgcactgccgaggccacggctttgacccggtctccggcggccagagctccaatctccggaccatccagtgtcaccaaccttcggccgtcgcacaccgcgcgcaccagcgtcgccttgcccaccccggccggacccgacaccagcacacccaaattggtgccggcgcccaaggtctgtagtaggtgcggctcatcgagggcaagcttgagccattcggtgagcttggcagcctgcggctgggcgcccttgagctcttcgatctggatctccggactcgagatgctcacttgcccggccgtggacgtacccattgcggccgggaccccagcgccccaggtgaccagcgagttgggctgcacgctgaccggcccgtcggggtcgacgccggtaacggtcagcagctccgaggtccaactgatcccgaccgcagctgccaatgcgcggctggcagccgacgtggatgtgccggggcctagatcgcggggcagcagcgagaccgcgtcaccgacggtcatcaccttgccgagtagggcctgccgcagcgtgaccggcggcaccgactgggtggccagcgttgaaccgctcagcgtcaccgatcgcgctccgtagacggtgaccgggctgacgatcacctcggtgccttcgcgaaggcccgcattggacagtgtgacgtcatcgagcagcaccgtcccgaccgcggtgtctgccgcggccaggccggcgaccgcggcggttgtccgagagccggtcagcgacaccgcgtcccactcgcggatgccaagggcagcaatggcattggggtgcaaccgaacgacgccgcggcgtgagtcgacggccgaggtgttcagccgggcggtaagggtgagttggcgggccgggtccgggtgggtcacagccgtcgacccggcttgcgcaggcccagccgcgccatcgacggccggtagggatgcgcccggcggctcgcgcgccgcaccgcgcgccgttgcttgggcttgtcgtcccacacctcagggtgttgggcaagccagcgctggctgcgcaccgcgaaaggaatatggcacatgtaggcgatgatgatcacccagatcaacaagtagggggccaggactgcggccgccgcgcagatagccagcaccgccagcagggcggccgcgtagttgggtggtaccgacacggcgtgcatctttttcatcgggatcccgctgaccaagagtatcgacgttcccgtcacccaaaagctgaggaaccagcccgaggtccaccatccttcgccgaactgcattttgagggctagcaggccgatcatggaaaccgcgcccgccggcgcgggcattccgacgaagaattcatgcgcgtaggcgggctgggttccgtcgtcctgcagtgcgttgtaccgcgccagccgtaataccacgcacaccgcgtagagcagcacgaccacccaaccgaccggccacttcgacaacatcgacacgtaaagcaccagcgcgggtgtcactccgaagttcaccgcgtcggccagtgagtcgatctctgcgcccatccgcgactgggcatccaggatgcgggccacccggccgtcgagcccgtcgaggatggccgctgcggcgatcagtgccatcgcggccttcggctggtgctcgagcgcaaacttgattgcggtcagtcccgcgcaaatggacagcaccgtcatcgcgctgggcagtatctgcaggtttacccctcgcctgccgcggggctttccgatcatcgacattcggccagcacggtctcgccggcgaccgcgcgctggccgacgttgacgatcggctctgcgcccgctggcaggtaggtatccagccgggagccgaaccggatcaggccgtaggtgtcaccgatggccagcttgtctccgacgtgtgcgtcgcacacaatgcggcgcgccaccagcccggcgatctgcaccgcgaccacctcggcgccgttgggcatgcggatccgcacactggtgcgctcgttgtcgtcgctcgcctccggtaggtcggccgacccgaaccggcccggccggtgttgcacggcgatcacttccccgctcaccggggcacgttgcacgtgggcgtccaatatcgacaggaagatgctgactcgcggtaacggcgtgtcacccatgctgagttcggccggtggggccgctgagtcgatcgcgcagatcacgccgtcggcgggcgcgacaatggcagccggcctggtgggcggtacccgctgcgggtgccggaagaagcccgcgcaggcagcggccgccagcagacccgtgccgcgcaaccaccggtagcggtgtccgacggccgcaatcgcaaggccggcggcaatgaacggccgcccggccggatgaaccggtggaacggcggaccgcaccagggcgagcagatgttgcgggccgtcggggcgggggcgtctggccacggggtcatcttacggagcttcgtgccgcaggttgggtgcacggcactaggatcggtccggttaggtcaagtcccagacttgcagctgcgttccggcagccacctccacgacgtcctccgggatgtccagaagtccgttggccgatgccaaccaacgcaaatggtgcgacgccggtgggccgtagctgatgaccgtgcctgcctggtgatcgagtattgcgcgtcggaactgacgtttgccgcgcggcgatgtcaggctcgcggtgagtaccgcgcttcggtgcggccggtacggatccggcaggcccatggccatgcgcagcgggggacggatgaacacctcgaaggacaccagcgcgctgaccgggttgccgggaagggtgacgatcggcgtacctgccacccgcccgacgccctggggcattccgggttgcatcgccaccttgacgaattcgacaccgtggtcgcctccccggtagtcagcgctgccgaacgcgtctttgaccacctcgtaggctccggcactgacaccgccgctggtgatgatcaggtcggcgtccaccgcgtaccggtcaaggatcgcgccgaactgcgcgacgtcgtcgccggcggttgcggtggcgaccacagcggcgcccgcatcgcggacggcagcggccagcatgatcgagttggactcgtagatctgacccggttgtaggggcgtgcctggcgacgccagctccgaccctgtggagatcaccagcacccgctgacgggggagcaccggcagctcggccaaacccagcgcggcggccaggccgagcaccgccggggtcacgatctggccgttgtgcagcaccgtggtaccggcggcgacgtcttcgcccgaccgtcggatgtgcttgcctggggtggcctgttggcggatcgccaccgaatcgacgccgccgtcggtggcttcgaccggcacgatcgccgtcgcaccggtgggcactggcgcaccggtcatgatccggtgcgcagtcacaggctgcagcgtcagcatgtcggcgcgcccggcgggaatgtcctcggcgaccggcaacatcaccggattttgcggtgtggcacctgaggtgtcttcggcgcgcaccgcatagccatccattgcggagttgtcgaaaaccggcagcgacagcggtgcgaccacgtcgccgcccaggaccagaccttgagcctgggtcagcggaaccgtaatcgggcgacaggcgcgcatcatctccgctacgacacgttgatgctcctggactgaccgcacccggccattatcggtcgttcagactccgaagctgacgccggtgagttcttcggagacggtccagaggcggcgctgcagatctttgtcgtgggactgcgcgctggattggaccaccttcgggtgaccgcgctgctcgccgaacccgtccgggccgtagtattgcccgccctgcgtggtcggatcggtggcggcacgcagtgttggcagggcgcccatctctgggctttggaaaagcaacggcccgagcacggtagcgacgggccggataagtcgcggcaggttgcgagtcagctcggtgttggagccgccagggtgagcggcgacggcgatggtggatttgcccgcttcgcccagccggcgttgcagctcgtaggtgaacagcagattagccagtttggcttgtccgtaggcggcgacgcggttgtaacggcgttcccactgcaagtcgtcgaagtggatggcagcgtgaatccggtggccctggctgctgacggtcaccacccgcgaaccgggtaccggcagcatgtggtcgagtaccagtccggttagtgcgaaatgaccgagatggttggtaccgaactgcagctcgaaaccgtccttggtgacctgcttcggcgtccacatcacgccggcgttattgattagcacgtcgatgcgcggataggccgtgcgtaacgcgtcggcggctgcgcgcaccgagtccagcgagcacagatcgagttgctgcagcgtgacgtgggcgcctgggcgggcggccatgatgcgggcccgggcggcgttgcccttctcgagattgcggacggccaacactacgtgtgcaccgcggtcggcaaacacggcggcggtgtggtagccgatgccggtgttggcgccggtgaccacaacgacgcgcccgctttgatcggggacgtctgcggccgaccatttacgggtcttgttgtcgttggcggtcatgggccgaacatactcacccggatcggagggccgaggacacggtcgaacgaggggcatgacccggtgcggggcttcttgcactcggcataggcgagtgctaagaataacgttggcactcgcgaccggtgagtgctaggtcgggacggtgaggccaggcccgtcgtcgcagcgagtggcagcgaggacaacttgagccgtccgtcgcgggcactgcgcccggccagcgtaagtagcggggttgccgtcacccggtgacccccgtttcatccccgatccggaggaatcacttcgcaatggccaagacaattgcgtacgacgaagaggcccgtcgcggcctcgagcggggcttgaacgccctcgccgatgcggtaaaggtgacattgggccccaagggccgcaacgtcgtcctggaaaagaagtggggtgcccccacgatcaccaacgatggtgtgtccatcgccaaggagatcgagctggaggatccgtacgagaagatcggcgccgagctggtcaaagaggtagccaagaagaccgatgacgtcgccggtgacggcaccacgacggccaccgtgctggcccaggcgttggttcgcgagggcctgcgcaacgtcgcggccggcgccaacccgctcggtctcaaacgcggcatcgaaaaggccgtggagaaggtcaccgagaccctgctcaagggcgccaaggaggtcgagaccaaggagcagattgcggccaccgcagcgatttcggcgggtgaccagtccatcggtgacctgatcgccgaggcgatggacaaggtgggcaacgagggcgtcatcaccgtcgaggagtccaacacctttgggctgcagctcgagctcaccgagggtatgcggttcgacaagggctacatctcggggtacttcgtgaccgacccggagcgtcaggaggcggtcctggaggacccctacatcctgctggtcagctccaaggtgtccactgtcaaggatctgctgccgctgctcgagaaggtcatcggagccggtaagccgctgctgatcatcgccgaggacgtcgagggcgaggcgctgtccaccctggtcgtcaacaagatccgcggcaccttcaagtcggtggcggtcaaggctcccggcttcggcgaccgccgcaaggcgatgctgcaggatatggccattctcaccggtggtcaggtgatcagcgaagaggtcggcctgacgctggagaacgccgacctgtcgctgctaggcaaggcccgcaaggtcgtggtcaccaaggacgagaccaccatcgtcgagggcgccggtgacaccgacgccatcgccggacgagtggcccagatccgccaggagatcgagaacagcgactccgactacgaccgtgagaagctgcaggagcggctggccaagctggccggtggtgtcgcggtgatcaaggccggtgccgccaccgaggtcgaactcaaggagcgcaagcaccgcatcgaggatgcggttcgcaatgccaaggccgccgtcgaggagggcatcgtcgccggtgggggtgtgacgctgttgcaagcggccccgaccctggacgagctgaagctcgaaggcgacgaggcgaccggcgccaacatcgtgaaggtggcgctggaggccccgctgaagcagatcgccttcaactccgggctggagccgggcgtggtggccgagaaggtgcgcaacctgccggctggccacggactgaacgctcagaccggtgtctacgaggatctgctcgctgccggcgttgctgacccggtcaaggtgacccgttcggcgctgcagaatgcggcgtccatcgcggggctgttcctgaccaccgaggccgtcgttgccgacaagccggaaaaggagaaggcttccgttcccggtggcggcgacatgggtggcatggatttctgaccccggcgagaagtcgcagcgaggagcccggtccctttgtggggccgggctcctctggttgggagctacggtaccgagaacaccacgcagtcgtgtaggcaacctttggccgctgtgggcgagtcgggggccgcgtctcggtgcagcagcgcgcggatgggtacgacaccgcagcgggcggtgtcgtcatcggggcctgcgtccgacgcctgggcacggccgtcgacgatcagcgagtagccgctaggatcggatggcggccacaacagggtgacttcgctgcggtgggccaggttttgccgcgtacgacccccgatcaggccgacgtcgaccactgcccggggtccatcggggccgtcggggagttcgcgcagcaccggctcgactgccaccgtgtgcacgcgatggccatcatcgacggtgatcaggtaagcgaacgggtagtcgggcaaggcggcggccagccgtttgaggtctacctttttggcacccacggattcgaggataggcgcccgatgtgttactccgaaccgaccggctgcccgatccgcgggctggcgtaggcggattcgcggtcggggctcgggtagaagttcgacttggggatgccggagccgggggtactcggctcacgcacggcggtattccgcaagcccgagtcgttgctgcccgagttgacgaagctcgggtagctggtgccagggcttctaaggcccgggtttgcgcccgagccagccgcggcactgccgctaccggggttcgggttgcctgagtccaggccgccaacaggagcactggccggggcggcgacgggcgtgttggtcaggcccgagttgaggacgttcgccaggccgtgttggagaccgcccgttgatccgagggcggaggcgaggatgcccgaactcaaagccgccgtgctcatgccgccggtggcgtagccggcggagctgaccaaggccgcctccgagccagccgcgcttcctaaggcggcgttttgcatccccgcgttccagaagctggtgttgaggctgcctgcgctgccgaggcccgcgttgattgtccccgaggtcccgatgccgctgttcagggagcccgaattcccgatgccgatgtttccgctgccggagttgaataagccgacgttgccggtgcccgagttcccgaagccgatgttgccgctacccgagttgaagccgccgaaacccatctggtgatcaccggtgatcccgaacccgatattcccgctaccggtgttgccgaagccgatattcccgtcgccgaggttgccgaggcccaggttgccgctgccggtgttgccgctgccgatgttgccggtgccggtgttgccgctgccgatgttgttgttgccgatgttgttgttgccgatgttgccgctgccggtgttgccgaagcccagattgatctggccgttcttgccgatgtcgatgccgaggttccgcaagacctgctgccagggcgccagttgtgcgacggccgcagacgcatcgaagtggtaaccagccatcgccgccacgtccaatgcccacatttgctcgtatgccgcctcgacgtccatgagcgccggagcattctgcccaaaccagttcgtagctgccagcagctgcatcaggccacgattggccgctaccactgccggctgcacggtggccgccagcgccgcctcgaacgcggtcgctattgccatggcctgtgcggccgcttgttccgcctgcgctgccgccgtgctgagccaggctaggtactgggttgcgacggccatcatcgccgccgcggacggacccagccaggcgccactagtcagttcggatgtgacggagccaagcgacgctattgacgcgagcaatttttcggccagctcgccccaggcggtggccgcagcaattagcggtcccgacccgggaccggcaaacatcagtgccgaattgatctctggcggcaaccacgcaaaatgcgggcttgtcactgatccaacttaactgtcagcgaccgttgccgtggcggtatcggcacttcaataccactcatctttggggtcatctttggagcgcccctaggaaccgccagcttacctagtcccgggtaggggccgactggcggccgggatgcagctgagggtctgccacctgccccgtaatgtcgctggtatggcaagcaccgacgccgcggcccaagagttgctccgcgacgcgttcacccggttgatcgaacatgtcgacgaactcaccgacggcctcaccgaccaactcgcctgctaccgcccgacccccagcgccaacagcattgcgtggctgctctggcacagcgcccgggtgcaggatatacaggtcgcccatgtggccggcgtggaagaggtgtggacccgcgacggttgggtggaccgctttgggttagatctgccgcggcacgacaccggatatggacaccgtcccgaggatgtggcgaaggtacgggcacccgccgacctgctgtcggggtactaccacgcggtgcataaactgaccctggaatacatcgctggcatgaccgcagatgagttgtcccgtgtggtggataccagttggaatccgccggttaccgtcagcgcacggttggtgagcatcgtcgacgactgcgctcagcacctcgggcaggccgcctacctgcgggggatagcccgataacggcgacatccgccggatcgctgaggcgatggtcagctacgccgaagatcgcctgcaccgatggttacctgacgctagccggcagcgccgccctagtggtacccggcgtgttcgtcgcgatgctgggcaccattgtcgcgccgagactgcggtgaggggccggggtgtgcgtcctcggctcacccgagcggcagctcggccaagatggtaccggtgggctgtggtgatccggtgccgggttcgacggtgaatgccagtgcggtcgaggctccgagatcggtcagcgtcgccgtcgtcgagggcgtcaccgccgcggtgcccatcgtccccgccgacctcggccctttggcccctcccagcagccacatctgatacacggttccccgggatggtggcgccacattgttcatcaccagcagacctgtgttgcggtcgcgggagaacaccaccgtggccgtcccggcgcccagtgggcgagagaccgtccgtacgtccggcgccgtcagaacttgctcggccacggtggggggtggcgatggccgggtcagcacccccaggccgaacgcccccagccccacagcgatcgccgctgcggacgcaaaggctgccgtacgccagcgtgattggcgcctaacctcgggcttggtcgcatccaggatggccgtccgcagatgtgctggcggctcggcggtggtggccgccgagacgacggccatcgtctcgcggacggctcgaacttcgtcgttgaaagccgcggctaccggcgagggcgcggcggccacccgtcggtcgatgtcggctcgttcatcgtcggacacagcgttcagggcatacggggtagccagctcgagcagctcaaaatcggtatgttcagtcatgagcgccgctctcccaacgcatcgcttcgctcggccggcgcagtcatgacacgtccaggcagttgcgcaggctgcgcagggcgtcgcgcatgcgggatttgatggtcgacagattggccgctaaccgccgcgaaacttcgacatacgtcagcccgccgtagtaggccagttcgatgcactgccgctgcgtgtcggtcaacgccttgaggcactcggtcacccggcgccgctcatcaccggcgatcgccaggtcggcgacgacgtcactcgcgggatcgacgttggccgcaccatagcgcacttcccgctggttgccggcttgctcgcaacggactcggtcgacagcgcgccggtgggccatggtcaaaagccaggccaacgcggaacctttggcggagtcaaactccgacgcgttccgccacacctcaagatagatctcctgggtggtttcttcgctgtagccggtatcacgcagcacccgcatcaccagtccatacacccgcgacttggtgtggtcgtagaattcggcgaatgcggcctggtcgtgaccagcgacccggcgcaacagggcgtccaggtcgctgctcagccgtggcggtccggtcatcgatgggtagcctatcgccagccggcgccgtgatggtcaagccggtcatcaccgacgcgccgatcgcggtggccggggcacgaaataggctgttcgcctttgatattcggcgaaaccggggcgacccttcaggtatctctcagtcagccgggctccgctgacgtccaccagcaggtaggtcatcagcagcggcgaacccaccgtggccagcggcgcccagtcgttgatcgtgatcaaccacaacccccaccagacacaggcatcgccgaagtagttggggtgacgcgtccaggcccacaggccgcggtccatgatgaccccgcgattggccgggtcggatttgaatacccacagttgccaatctcccaccgcttcgaaggtgataccgaccagccacacggctaagcccacgcccccaacagccagtaacggcttcggcgtcggcccggtgactgcggaaagctgcagcgggaatgagacgaacaacgtcaggaggccctgtaatccgaagaccttgcgcaatgcctgcacaggcgtggcaccgcgcagcaggtcggcgtagcggggatcctccccctgaccggctgtcttgcggtacatgtgccagctcagccgcagaccccaggtcgacaccaacgctagtagcagccatcggcgaaccgggtcgccgtggccgagcgtcgcggcggcgacggcgacggcgacgaaacccaagccccataccacgtcgacgacgttgtaccggccgatgcggcggccgatcgcaaacgccaccgaatgcaccacggccacagccaaagccgacacgctggttaccacgacgatgttcacggggggccctcgcggatcaacgtccactggtagacgtccagatagcccgaccggaagcccgcctccgagtacgccaggtacagctcccacatccgtgcaaacacctcgtcgaaacctaaatgcgccagcccatctcgccgctgcataaatcgttcccgccagagccgcagcgtctcggcgtaatgcggtcgcagcgaggccgcgtcgacgatgcgcagcccggtgtgttgcccggtgatgtcgatgatggcctgcgtggacggtagcagtccgccagggaagatgtacttctggatccaggtctgggtgtggcgggtggccagcattcggtggtgcggcatggtgatcgcttgaatcgctaccgggccacccgggcgcaccaactgttctagcgcggcgaagtaccgtggccacgaacggtatcccaccgcctcgatcatctcgactgagactactgagtcatactgcccgtcgacgtcgcggtagtcgcacaagtcgatctctacccggtggccaaagccggccgcggcgacccgctgccgagccagccgttgctgctccaccgatagggtcaccgagcggatgtgggccccccgtgcggccgcgcgaatgcacagctcgccccatccggtgccgatctcgagaacgtggctgccctgctggaccccggccacgtcgagcagccggtcgatcttgcggcgttgggctgcggccaactcggtccaggcgggagttggctgggccagcaggtcggtgaacattgcgcacgaatacgtcatggtctcgtcgagaaacgcggcgaacaggtcgttcgacaggtcatagtgcacggctatattgcgccgggcctgatctcggctgtggtctggccaactaggtcgaaaggtcggcgtgatcggccgcagccagtgcagcgagcgcggtaccagctcgtccaccgaccctgccagcacggtcaacacccgcgtgagctccttcgacgaccattcgccggccatgtaggactcgccgaagccgatcaagccgtggcgcccgatccggcgtgcaagtgcgtccggccgatggatgaacaggctgggtgcgcgcggatcggcggcacctgttgccgttccgtcggagtagaccaatcgcagcggcaagtgagtggccgtgcgccgaagcagccggttggcgattgccgccgatgccgcggctaggggaccgcgcggcaccttggcaaccgctggccagcgatccgaatcgattgctgccgacggtgtctggctggtttcgacggtcatcgcggcaccaccggaactcgacgtagccacagtctgatcccctgtatcctgatgcgcgcggccaccaccatcggcgccagcggtgaaatgatttgcatcatcgcgatctgtcttgtcgttgccggtcgccgctgcccacgcagggtggctgtgaattccgggcacacctgccggcggtcacggtgcagcgtcaccgtgacgtcgagttcgcggtcgggccgtggtgcccgtatcaggtagtagccggctagctgatgaaacggcgaaacgtagaagttcttggccgtcaccacgggcaggtcggccggcggtagcaggtaagcatggcgtccgccgtaggtgttgtgcacctcggcaatgacatggcgcagttggccgtcgcggtcgtggcaccagaagatgctcaacgggttgaagacatagccgagaacgcgtgcttgcagcagcgcggtgatacggccgtcggggacggcaaggccgcgagcggcaaagaaggcgtccagccggtcacgcagcgagctatgcggcggacacgagaacgggtcagcgaagtggtcgtcggcgtggaaccgtgcgaacggtcgcagccaccagggcagctgggggaggttgtcgacatccacgtaccagctgtagctgcggtatgcgaacgagtggtgcaccgggacttgtctgcagtggctgatcgtggtgcggtagatcgccggcgtcagggtttgagtcagcacgcgaccatcgcctcctgtgggatcgctgccggccagtcggcgccaaggcgccgggccgcccgcagacccgaggcggcgccgtcctcgtggaatccccagccgtggtaggcgccggcgaataccacccgattgtcacccagcgtcggcaataagcgttgggctgcaaccgattccggtgtgtacagcggatggctgtaggtcatctcggcgatcaccgagctgggatcaacccggtcgtggccgccgagggtgaccagataccggcggccaccgtcgaggcgcattagcctgctgatgtcgtagctgaccacgacctggtgctgcccgggtgtcaccaggtagttccaggatgcgcgggcgcgatggtggcggggcaggaccgactcgtcggtgtgcagctgggcgctgttggtggagtatgcgatcgcgcccaggaccgcgcgctcggccggtgtcggctcgtcgagcaacagcagcgcctggtcgggatggaccgcgacgacggccgcatcgaaacgccgcgacggcccatcacccgcgcccaccaataccccgtccggcagccggcgcagcgagtgcactggcgtgcgggtcgacacctcgtccagctgagctgcgatcgcctgcacgtagttggcggaacctccggtgacggtacgccaggttggcgacccgaacaccgacagcatgccgtgatggtcgaggaagacgaacagataccgggccggatagcgcaaggcgtcggccccgccgcaggaccacacggcggcgaccaagggtgtgatgaagtaatcgacgaaatactgcgagaagtggtgccggctcaggaaggcttccagcgtctccggtttgtcttccgcgttgtcggtctcctcacgcagcaggcgagccgcggcgcggtggaagcggagaatctcggcaagcatgcacagataccgtggccgcagcgattgccggcaagcgaacagcccgcgcgctcccagtgcgccggcatattcgagtccgatgtcgtcggcgcgcaccgacatcgacatttccgactcctgggtggccacacccagttcggcgaacaatcggcacaacgttggataggttcggtcgttgtgcaccaggaacgccgagtcgacgccgacgacgtcggtgccccgggggccgccaccgttgtccagatagtgggtgtgggcatgaccgcccagccggccgtccgcctcgtacagggtgactcggtcccgtccagacaggatgtaggcggcggtgaggccggcgaccccacttccgacaacagccaccgatcgtcggagtgattgctgcacatcctgtattcggagcggccggctagacggacgggcggttcagccgaggcggtcgctgctcatcgccaagggccggcccgcgggctgggtttcgctgggtacggtcggggtccgggcgggccgggaacgcacccgcagcggccaccagaaccagcggcccagtagtgcggcgatggatggcgtcatgaacgatcgcacgatcaacgtgtcgaacagcaaacccagaccgatggtggtgcccacctgtccgataacccgcagatcgctgacggccatggacgccatggtgacggcgaataccagccctgcgttggtcacgaccttgccggtgccgcccatcgaccggatgatgccggtcttcagccccgctcctatttcctgtttgaaccgggagaccaagagcagattgtagtcagatcccaccgccaacagaacgatgaccgacatcgcaagcacgagccaatgcagatggattgcgagaatatgctgccagagcagcaccgatagtccgaaagaggcacccagtgaaagtgcgactgtgcccacaatgacggcggcggcaataaaggcccgtgtgatgatcagcatgatgataaaaatgagacagagggacgaaattgccgcgataagaaggtcccattgggcgccctcggagatgtcgtggaagacggccgccgtgccggccaggtagatcttggcgtcttctagtggagttcccttgagcgattcctcggccgcggtacgaatcgcgtcgatacttttgatgccctcgggtgattgcggatcccccctgtgcaggatgataaaccgggccgcgtgtccgtccgaagacaggaacgacttcatggcgcgctggaagtctttgttcttgaaaacctcgggtggaaggtagaacgagtcgtcgttcttggcggcgtcaaaagccttacccatggctgtggcattgtcgctcatttcgagcatctggtcgaagattccggtcatggtgctgtgcatggtaagaatcatggtccgcatgttttccatggcctcaatctgcggcgggatctgcgcgaccatttgtggcatgaggcgatccatctcgcgcaagtcgcccaagaggacgcctatttgctcgctgagcttgtcgattccgtccagtgcatcgaatatcgatctgaacgaccaacagatcggaattccgtagcagtgcttttcccagtagaaatagcttcgaattggtctccagaaatcatcaaaatccgcgacgtggtcgcgtaattcttcggtgatctccttcatctcttcggtgtcgccgaccatgcggtgggtagtactggccatctccgccatcaagctatgcatccgcgtcaacaccgcaatcgtcgtggccatctcgtcggcctgcttcagcatgtcgttcgcccggtcgcgctggtactttatggtctgcagctgaccggcattttgcatgctgatctggaacgggatcgacgtgtggtccatcgtcgttccttcgggccgggtaattgcttgcacacgggaaatgcccgggacccggaagatgcctttagccagcttgtccaggaccagaaaatctgccggattccgcatatcgtgatcggattcaatcattaggatctcgggcttcatcctggcctgagagaaatgacgatccgcggccgcatatccttggttggcgggtatgaagtccggtaggtagtcacggtcgttgtagctggttttgtatccaggcagggcgagcagaccgactagggcgatcgcgcaggtggcgacgagaacgggcagcggccagcgaaccaccacggtacccacccgccgccagccacggactttgaggagccgcttagggtcgaacaggccgaaccggctgccgacgtgtaggacggccggacccagcgtcaacgcgaccgccactgcgactagcatccccaccgcgcaggggatgcccagggtttgaaagtagggcatgcgggcaaagctcaggcaaaaggtagctccggcgatggtcaatccagagcccagaatcacgtgggcggtcccgcggtacatggtgtagtaggcggcctctttgtcctcgccggcttggcgggcttcctggtagcgcccgatgatgaatatcccgtagtccgtaccggccgcgattgccagcgaagtcagcaagctcaccgcaaaggtggtaagtccgatagccccgctatgccccagaaccgctacgactccgcgcgcagccgtcaattcgacccccaccgtgatcagcaggagaaccacggtgattatcgaccggtagacgagcaacaacataataaagatcacggcgaccgtaaccatggtgatcctggccatggatctatcgccactgtggtgcatatccgcggcgagtgcggatggtccggtcacataggcctttatgcccggcggcgcgggcgtgctttcgacgatgctgcgtactgcctcgacggattcgttggccagcggcgtgccttggttgccggcaagtgacagttgaacataggcggccttgccgtcgttactttgcacgcccgcggcggtgagtgggtccccccataaatcttggacactttgcacgtgcttcttatcggccctcaattgagcaaccaggccgtcgtaatacttatgggcagcgtcgccaaggggttggttaccctctattatgaccatcgcgaaactgtcggaatcgccttccttgaacaccatgccgatacgtcccatcgcctcaaacgacggtgcatccttgggactcagcgacaccgatcgctcttggccgacagcttccagtgacgggacaaatacggtgacaacgacgcaaactgccagccagccaaggatgatcggtaccgcaaaggcgtggatcatcctggcgatgaatggcttttcggggcgagcgttggtattggagtcgttcgcgaatttagtactcacgcggacttcaccaagcagtaagtataggcgttgacttcgttggaaaccctctcggccctgaccttgccgtctaccgtgattcggcagccaatgctgtcgctattaccttgtgccacgatatttcccatcaccgccgcgtcgtttgtcgtgatatgcaatgaccacggtagcaccgctccatcgacccgttgcggctcggaattgacgtcgaaataactaatgtcggcgactgttccggggggtccgaagatctcgtaagtcaggtgtttagggttgaatggtttgctgttttccaggttggtgtcggagtacgacgggcggttttcggagccgaagaagccgcggatccggtgcacggtgaagcccccgacgatgaccaccaccaggatgaccagtggaatccaagtccgcattagcaccttgaaaatctcagatccccttcaccggttggcagtggtacggcggacgatacccaactttcaaaatccgttcgagctggtcgctacttgaacgcaactaagcctagcctaagtaaaacatggttttaggcccgagctctcgactccttacctcgttcgctggagtgtaacgcatatcacgtgcgtaacggcacgctacgttatcggcagccctcttacaaatcacacggtgtgcgttatcctctggcggtggcgcaactcggcttccagcgcgcccgcaccgaggaaaacaagcgccaacgtgcggcggcgctggtggaagccgcgcggtcgctggcgctggagacgggcgtggcatcggtgacgttaacggctgtcgcaggtcgtgccgggattcactactctgcggtgcgccgctacttcacctcgcacaaagaagtgctgctgcacctcgccgccgagggttgggcgcggtggtcgggcacggtatgcgagcagctgggcgagccggggccgatgtcggcaccgcgggtggccgaggcactggccaacggtctggccgccgatccgctgttttgtgatctgcttgccaatctgcatctgcatctcgagcaggaggtggatgtcgaccgggtcatcgaggtcaagcggaccagcatcgcagccgtgatagcgctcgtcgacgcgatcgaaagcgcattgccggcactcgggcgttctggggcattcgacatcctgctggccgcttactcgctggcggccaccctgtggcagatcgccaatccgccggagcggctcaccgacgcctatgccgaggagccagagttgctcccaccggagtggaacctcgactttgctgccgcgcttactcgcctgctcaccgctacgcttctcggcctgctcgccggatccccatgcgaatgccggtcgccaacgcgctgaagcgggtgcgggacgaagggggcgccggacttgggcccgcttggcggcggtaggtgaccaaactcacgcttcttgggcgtgcgccgcagccgaaccacgactattgctagttgcaaacgatagtcatagtcaattgttgccagacgcacagctggtgttggcgggagtcgccgatagaggagtgttcgacatgacgttgcacgtcggtgccgacggcctagagaccgcaactacggcgcgcgccgtggcggtcgctaggtccggaatggattgtgtggccggtgatgcgtcaggggcgacttcgtgcctacgcggtgagctatgacgagcgcactgatatggatggcctctccgccggaggtgcattcggccttgttgagtagtgggccggggccggggccggtactggccgccgccacagggtggtcgtcactgggccgtgaatacgccgcggttgctgaggaactcggggcattgctggctgcggtgcaagccggggtgtggcaggggcccagcgccgaatcatttgctgccgcgtgcctgccgtatctgtcttggttgacgcaggccagcgccgactgcgccgcggcggctgcccggctggaggcggtgaccgccgcctacgccgcggctttggtggccatgcccaccctggccgagttggcggctaaccacgcgacccacggggccatggtggcgaccaatttcttcgggatcaacaccataccgatcgcggtcaacgaggccgactacgtgcggatgtggcttcaggcggccaccacgatggccacctatcaagcggtcgcggactcggcggtgcgctcgatcccggacagcgtgcctccgccgcgaattctgaaatccaatgcccaatcccaacactcgagctcgaataattccgggggcgcggacccggtggacgacttcattgcagagatcttgaagatcatcaccggcggtcgcgtgatctgggaccccgaagccggcactgtcaacggcctcccctatgacgcttataccaaccccggcacactcatgtggtggattgccagaagtctggaacttcttcaagactttcaagagttcgccaagctgctgttcaccaatccggtgaaggcttttcagttccttgtcgacctcatcctgttcgactggcctacacacatgctgcagctggctacctggctggccgagaacccgcagttgctggtggctgcgctcaccccagccatctccggactgggagcggtatcggggttggccgggttgaccggcctagtccctcagccccccgtcgtgcccgcgccggcacccgatgcggtcgtgcccaccgtgttgccactcgccgggacggccacgccgactaccgcgccggccagcgccccggccgccggagcggcgcccgggcccccggccggtaccgccactgccacatcggcgtcggtgccaacgagcgccggcggctttcccccttacctcgtgggcagcggtccaggcatcgacttcgacgcggggacgcccgccggttccaggagagcgcagcccgccgcggataacgtcacggccgtggcggcagcgcaggtgtcggcccgtcatcaggcacgtcggcgccgacgagcggcggcgaaggaacgtggcaacgccgacgagttcgtcgatatggactccggcccggcgattccgccgtcgggcgagcgggacgcttgggcgtccaattcgggcgtgggcgggctggggtttgccggcaccgcaagcaacgagacggtggcagcgccggccggattgaccacgctggccgacgatgagttccagtgtggcccacggatgccgatgctgccgggcgcttgggacttgggaacttgggaccgcggggactgattaccctacaacgcagcgacgtcgcgcatgatgtcggtgggttcgcgcaccggcgccccacaggtcaggcagaacgcgcccggggaacgggtgagccgaccgacttgaagcaggactttggcctcgacgtgccacaagcaggcaatgcacagaatttcgacggtgttcccgaatgggtccaggtcggggtcgttacattcgtctaccgcatgcagatgcaccacgtaactcgcccggttggtgcacccggctccggactggcaggtgattccaccccagtccagggccgccagcgtgtgtgggatctcgttgccgggcgcttgactcatgcgccgcgctccagtgtccaggccatgcggcccacgatgtttacctctgccccgcaacggcatggtatcccggcgcgtggccggtggtggctgggctaccaagagcgaagtcgggcatggccttagtcctagtggtacgcgataggtcgtcgaattccgtgggtgatggatatgactatttcgtagctggtcgccagaatcaatccgccgaacggcggctgatgggcccaacgggctgtcccccgaatggtggacaacatttccgggttcgttgcaaacgaccgcgctttgacgccggttagctttaggccggacttaggcccagttccacaccgacatgtcgccggctgggtatccattgcacacctcggtccctttagcgacgacgcccttgttgttgaagaagattttcatgtgattgacccaggcaaacgtcagcggatcgccattgtaaaagtgttcggagtagtctcggcgctccgccggtgacagcgagaagaaccagtgcgccttgttgatcgtcgcttgctgaaggtttgcatggttgttgaagtcgatcatgtaccgctggtagtacaccggactggtatcccgcaccgccgccagatattgttcggcgtcgcaggtggttgcgatcatccggcgaggtattggaaagtcttccgtggagtcggctgccgcgctttgtggaaatgtcgcagcggcgatgccgagaaccagaaatgccgcgccggcacgcaggatggaactcagccgagacatagtggttaccgtagcacttttggggcgcctcgaggcgggcagacgacaaggttcatagtctgtctcactacatgctcccatcaggagtgatgacgtgcgtggggtcgggtcgcagttccggtggggcttggctgtagtcgccgaacgggccgtcgcggcgctcgaccgcggctcgcacaccctgggtttgggcggtccggatgaactcgagcgcgtcgggggtgttgcgcatcagcccgtcgagaatgccgcccagcagctgggtggaggccaggcccatgttctcgtaggcctggttgacgatcagtttctgggcttgcaactgtgacaacgggattcgtgccagctcggtggcgatctcggcgacgcgagcctcgagccgctcgaacggcaccgcctcgttgatcagctcggcttcggcggcctgcacaccggtcagcggccggcccgtcagcgagtgccatttgaccttggcaaggctgagtcgatacagccacatcccggtcaaataggctccccacatgcggctatacggagtcccgatcacggcgtcctcgctggcgatcacaatgtcggcacacagcgcgtagtcgctggccccgccgacgcaccaaccatgcacttgcgcgatcaccggtttggacgcccgccagatggccatgaatttctgcgtcggtccggtctcccgcgcggtgaccatggcgaaatccttgcccggatcccatcggccgtcggtcatcatggcatcgccccaatgctggaagccgccgccgaagtcgtaaccgccggagaaggcgcggccggcaccgcgcagcacgatgaccttgatgtcctggtcgcgctcggccaacccgatagcggcctcgatctcgtcgggcatgggcgggacgatggtgttgagctgttccgggcggttgagcgtgatggtggccaccggcccggccgtcgtgtacagcagcgtctggaaatcgggtgtcggcatagcagcagcgaagtcacttcggccctaagggtcaagtgtctcagcggggatcgtgataacgccgctggttcgaagcttcggccaacccgggcgcagggtttcgctagctggcatttgcatgcctcgggcatcggtgtccggttgcgctctttgctccgacgttagccgcagggccctgcggctaggcgcggccggtgccgttggccgcggcggcaatcgatgttgcagcagttacaacgccaaatggagtctgagcgcatcgtcgagttcgatcagctcggcaggggagacgttgcgcagcgacggatccaacctgctgggcctgcgccttcgaatcgacggccaggccaccgctcgctgccggcaacaacacctggaatggggaccttttcggtgttgctggtaaccgggacaaccggcaccacgcctcggtcgagacgtatcgcggcagcgttggccctgtcgttgctgacaattaccgctggccgccgcatatttgccgcgctgccgcgggccggatccaggtcgacctgccagatctcaccgcgcagcatctacgccgttcgctgcaaaccgccgactgcgacggcaggcccactctcttggcatgcgtccaatgctgcgacgtcctcggtagacaagctcacgcttggcttcatgccgcagtcctacccatgtagtaacagatagtaatacgtagtaataggtagtaatgcagtatcaatcggctacaactcgatagccacgttatttgggctaagtccaccgttcgtgaatgccggttagccggccagcatccgccataggaacgcgaaactcagcgccgatttgaatgcgatctgtgcgttgtcggctgcgccggcgtgcccaccctcgatgttttcgtaataccagacggggtggcccgcagcctgcagggccgccgtcattttgcgggcgtggccggggtgcacccgatcgtcgcgggtagaggtcgtcatgagtactggcgggtatttccggttcgccgaaatgttttggtatggcgaatattcagagatgaacttccagtcatccgggttatccggatcgccgtattcggccatccaggaagcgccggccagcagcaggtggtaccgcttcatgtccagcagcggcacgtcgcagaccagcgcgccgaacttctccgggtacccggtcaacatgatgcccatcagcagcccaccgttgctgccgccccgcgcgccgagctgctcagcggtggtgatgccgcgggtcaccaaatcggttgccacggcggcgaagtcttgggcgaccttgtcccggccctcgcgcatcgcctgcgtgtgccagccaggcccgtactcgccgccgccgcggatgttggccaacgcataggtgcccccgcgggccagccacagccggcccaggacgccgtcatacgtcggcgttctggatgtctcgaatccaccgtagccgttcaacaatgtggggccgggattgtccgcgtcggtgcgtcgcacgacgaaatacgggatcgatgtgccatcgtctgatgtcgcgaaatactgtgttacagccatgttttccgcgtcgaagaaagctggcgcagatttgatctctgctagtcggccgtcatcggtgccgcgcatcagccgcgacggcgtatcgaatccactggagtcgaggaagaactcgtcgccgtggctgtcggcggagacgatgacggtgttggtggcggcggggatacctgagagtggctcacgtcgccagctgccgggagttgcgatctcgacgcggctcgccacgtcggccagggtgacgatcaacagccggtctcgggtccaggcgtattggtacagcgcggtgtgctcgtcgggttcgaacaccacctgtaattccgctgagccggcaaggaattcgtcgtattcggcggccagcagtgagccggcagtgtacctggtggtggccacggtccagtcggtgcgcagctcgatcaacagccagtcgcggtgaattgacacgctcgcgtcggtgggggcttcgattcggatcagctccgaaccacgcaattcgtagacctcttcgttccagaagtcgagggcccgtcccagcagggtgcgctcgaatccgggcgtgcgatccgctgacgcgttgacgcggacgtcggtgcccgcgccctcgaagattgtctccgcatcggccagcggtttgccccggcgccatcgcttgatcactcgcggatagccggaagtggtgagcgagtcgccgccgaagtcggtgcccagcaagacagtgtccgggtcctcccaggtaatctgggatttggccggtggcagctggaacccatcctcgacgaattcgcgtgtcagcatgtcgaattcacgcacaatggatgcatccgagccgcccggggacaggccgatcagcgcgcgcgtgtagtcgggttcgatgacaccggcgccgccccacacccacttctggtcgtcggcgcggcccagttcatcaacatcgatcagcacatcccagcccggcgagtcggtgcggtagctgtccagcgtggtgcgccgccacaacccgcgggggttggcggcatcgcgccagaagttgtagagatagttgccgcgcctgttcacataggggattcgggcatcggtgtcgagcacctcgagcgcctcgacgcgcatccgctcgaactctgcgtcgcagaacgccgccgttgtcggcttgttgcgcgcgcgtacccaatccagcgcttccgcaccggtgacgtcctcgagccataggtaggggtcagcgccgtctggggcaggctcaaatgtcatggaagccattgtggccccggcggtagtgtgagctgtattacatgattttgacgaggagccgaatacgatgactgtcttttcccgtcccggttccgccggggcgctgatgtcctatgaatcccggtaccaaaacttcatcgggggccagtgggtcgcgccggtccatgggcgctacttcgagaacccgacgccggtgaccggccagccgttctgcgaggtgccgcgctccgacgcggccgacatcgacaaggcgctcgacgccgcgcacgcggcggcgccggggtggggcaagaccgcaccggccgaacgggcggcgatcctcaacatgattgccgaccgcatcgacaagaacgccgccgcgctggcggtggccgaggtctgggacaacgggaaaccggtccgggaagcgctggccgccgatatcccgttggcggtcgatcacttccggtacttcgccgcggcgattcgcgcccaggagggcgcgctgagccagatcgacgaggacaccgtggcctaccacttccacgagccgctcggcgtggtgggccagatcattccgtggaacttccccatcctgatggcggcctggaagctggcgccggcgttggcggccggcaacacggcggtgctcaaacccgccgagcagacacccgcttcggtgctctacctgatgtcgctgatcggtgatctgttgccgcccggggtggtcaacgtggtcaacggattcggcgccgaggccggcaagccgttggcctccagcgaccgcatcgccaaggtcgcgttcaccggggaaaccaccacggggcggctgatcatgcaatacgcctcgcacaacctgatcccggtcaccctggaactcggcggcaagagccccaacatcttcttcgccgacgtgctggccgcccacgacgacttctgcgacaaggcgctggaaggcttcaccatgttcgccctcaaccagggcgaggtgtgcacctgcccgtcgcgcagtctgatccaggccgacatctacgacgagttcctggagctggcggcgatccggaccaaggcggtccggcagggcgacccgctggacaccgaaaccatgctgggttcccaggcctccaacgaccagctggaaaaggtgttgtcctacatcgaaatcggcaagcaagagggtgcggtgattatcgccggaggcgagcgcgccgaactaggcggcgacctgtccggcggttattacatgcagccgacgatcttcaccggcaccaacaacatgcggattttcaaggaggagatcttcgggccggtggtcgcggtgacgtcgttcaccgattacgacgacgcgatcggcatcgccaacgacaccctctacggcttgggtgccggtgtgtggagccgcgacggcaacactgcctatcgggccgggcgggacatccaggccggccgggtgtgggtcaactgctaccacctctaccccgcgcacgcggcgttcggcggctacaagcagtccggcatcggccgggagggccaccagatgatgctgcagcactaccagcacaccaagaacctgctggtgtcctactcggataaggcgctggggttcttctgatgaacgctcccgcgggggtgctcatcaccgccgaggccgccgcgctgctggctgggttacaggaccggcacggtccggtgatgttccaccaatccggcggctgctgcgacgggtccgcgccgatgtgctacccgcgggcggacttcctggtcggtgaccgcgacatcttgctgggtgtgttggacgtcggggaagacggcgtgccggtgtggatttcgggcccgcagtaccaggcctggaagcacacccagctgatcatcgacgtggtgccgggccgcggtggcgggttcagtctggaagcgcccgagggcgtgcgctttctcagcagaggtcgggtgttcagcgacgccgaaaaggcgatgcgggaggctgcgccggtgatcaccggcgcagcctacgagtgcggcgaacgaccgttagtgcggggtcttgtcgtcgatctcgacgatccagatgccacgccgggagtgtgccgcgccagtcggcggtagccgcagtaaggtcgtagaccgtgatcccccttccgcggtcatggcagctgaccagcgcgatgctggttggtaatgcgatcggactgctagcgggggtggcgtgcagcgtgctggtgcatgcccggatccgtccggacatcgtcatcgcaatggtagtcgggattcccagcgcgatcgggctgctggtcatcctgttctccggacgtcgatgggtgacgatgctgggcgcgttcatcctggcgttggcgccgggttggtttggtgtgctggttgcgatccaggtggcgtccagtggctgacaacgattaccggtcggcacccggaaccgagccgtttgtgcccgatttcgacaccggcgcacactcgcagcggttcctctcgttggccggccagcaagacagggcggggaaatcctggccaggctcgacgccgaagccgcaggaggaccccgtgggtgtcgcgccttcggccagcgtcgaggtgctggggtccgagccggccgccacgctagcgcactcggttacagtacccggtcgatatacctacctgaagtggtggaagttcgttctagtggtcctcggcgtatggatcggtgctggcgaggtcggcctgagcttgttctactggtggtatcacacactcgacaagacggccgccgtgttcgtcgtcctggtctacgtcgtcgcgtgcaccgtcggtggcttgatcctggcgctggtgccgggcaggccactgatcacggcgttgtccctcggagtgatgtcggggccgtttgcctcggtcgccgccgcggcgccgctctacggctactactactgcgagcggatgagtcattgcctggtcggcgtcattccgtactagtcggttgtcggacttgacctactgggtcaggccgacgagcactcgaccattagggtaggggccgtgacccactatgacgtcgtcgttctcggagccggtcccggcgggtatgtcgcggcgattcgcgccgcacagctcggcctgagcactgcaatcgtcgaacccaagtactggggcggagtatgcctcaatgtcggctgtatcccatccaaggcgctgttgcgcaacgccgaactggtccacatcttcaccaaggacgccaaagcatttggcatcagcggcgaggtgaccttcgactacggcatcgcctatgaccgcagccgaaaggtagccgagggcagggtggccggtgtgcacttcctgatgaagaagaacaagatcaccgagatccacgggtacggcacatttgccgacgccaacacgttgttggttgatctcaacgacggcggtacagaatcggtcacgttcgacaacgccatcatcgcgaccggcagtagcacccggctggttcccggcacctcactgtcggccaacgtagtcacctacgaggaacagatcctgtcccgagagctgccgaaatcgatcattattgccggagctggtgccattggcatggagttcggctacgtgctgaagaactacggcgttgacgtgaccatcgtggaattccttccgcgggcgctgcccaacgaggacgccgatgtgtccaaggagatcgagaagcagttcaaaaagctgggtgtcacgatcctgaccgccacgaaggtcgagtccatcgccgatggcgggtcgcaggtcaccgtgaccgtcaccaaggacggcgtggcgcaagagcttaaggcggaaaaggtgttgcaggccatcggatttgcgcccaacgtcgaagggtacgggctggacaaggcaggcgtcgcgctgaccgaccgcaaggctatcggtgtcgacgactacatgcgtaccaacgtgggccacatctacgctatcggcgatgtcaatggattactgcagctggcgcacgtcgccgaggcacaaggcgtggtagccgccgaaaccattgccggtgcagagactttgacgctgggcgaccatcggatgttgccgcgcgcgacgttctgtcagccaaacgttgccagcttcgggctcaccgagcagcaagcccgcaacgaaggttacgacgtggtggtggccaagttcccgttcacggccaacgccaaggcgcacggcgtgggtgaccccagtgggttcgtcaagctggtggccgacgccaagcacggcgagctactgggtgggcacctggtcggccacgacgtggccgagctgctgccggagctcacgctggcgcagaggtgggacctgaccgccagcgagctggctcgcaacgtccacacccacccaacgatgtctgaggcgctgcaggagtgcttccacggcctggttggccacatgatcaatttctgagcggctcatgacgaggcgcgcgagcactgacaccccccagatcatcatgggtgccatcggtggtgtggttaccggctacatcctctggctggcggcgatctccgtcggcgatggtctgacgacggtgagtcaatggagtcgcgtggtgttattgctgtcggtcctggtggcggtgtgcggcgcggcgggcggcttgcggctgcgcagccgcggcaagctcgcgtggtcggcgtttgctttcagtttgccgattcctcccgtggtgctgaccgtggcggtgctggccgacatctacctttgacggctactgtgggttgtccggcgggatggccagggcggtgatcgttgcggcgatcgcgtcgtattgggttgcgagtaaacagaattcgatcaacaggcgcggatcgaggtgagttgccagccgctcccaggtgcccgcggtgatcgtgcgatccttgatcaattcatcggtagcctgtagcagcgcctgttggcgggcgctgagcacttttcgcggtccgtctccatctggaacgtcgggccaggcgaatatcgtggcctgggtgttggcgtctaggccccgacggcgcgccattcggcgatgatgctgaagttcgtattcgcaagatcgtaggtgtgcgacccgaaggatcaccaactcggtatcgacgccgggcagccgcccgtgcagtagtcggccggtgtagatggcaaaggtccagaacaagtactggcggtagcccagcgtggtgaacaggtgcatctgcggtgccccaaccgcacgtgcggccagcttggccaccagccagttgaccggccccagctggcggaacttccccggggagatacgcgcgacttggccgttctgaccggtcatagttgtttcaccagatacggggacaccgtgctgcggtgttcgtcgagatccagtgcccgccccaaggcggggaaggcgcgttgcggacagttgtcgcgttcgcagacgcggcaaccggcgccgataggtgtggccgcagtattcgggtcacccgacaagtcgagtccttccgagtagacgagccggtgcgcgtggcgaagttcgcagcccagcccgatcgcgaaggtcttaccgggctgaccataccgggcggcccggagctcaacggtgcgggccacccacaggtagttgcggccgtcgggcatctgggcgatttgcaccaagatcttccccgggttggcaaacgtttcgtagacgttccacagcgggcaggtgccgccgctggaggagaagtgaaagccggtggccgactgacgttttgacatgtttcccgctcggtccacccggacgaaggtgaacgggaccccgcgcatcgaaggccgttgtagtgtcgacagccggtgggcgatggtctcgtagctcaccgagtagaacgccgacagccgctcgacgtcgtagcggaaattctcggcgacgtcgtggaactggcggtagggcagcacggtggccgcggcgaagtaattagccaggcccagccgggccaacgtccgcgactcggcgctggtgaacttgccgtcggtgaccatggcgtcgatgaggtcgccgaactcgagataggccaactcggcggccatcttgaacacctgctggcccggggagaggtgactgctgatctccagcgtgttggtcgcggggtcgtagcggtgcagcacggtgtcaccgaggtcgatgcgcttgttgatgcgtactccgtgcacctcggtgagccggcgggtcaattcgcgggccaggtcgccgtggtgcatccgcatctgggccgtgaggtcttcggccgcggtgtccagcgcatgtagatagttctggcgttggtagaagtagtcgcgcacctcttcgtgcggcatggtgatcgaccctcggccactgccgtcggagaaccgctcctcggtcgcggcggccagctgcgcggtggtgatccggtagcgccgatgcaggttgaccaccgcgcaggccagcccgggatgagcgctgaccatttcggccacttcatgcgggtcgatggcgatgtctagatcgcggtccagggtcacctccctgagttcggcaaccagccgggtgtcgtcctgggaggcaaagaacgtcgcgtccaccccgaacacttcggtgatgcgcagcagcacggccacggtcagcggccggacgtcgtgttcgatctggttcagatagctcggcgagatctccagcatctgggccagcgcggcctggctgaacccgcgctcgttacgcagttggcggacccgcgagccgacgtaggtcttggacacccaaccgagcgtaccgggtgttgtgaagacgccattcgcagagttagcaagcgtgctgcgattggtgtttccgccacggcgttggcatgattcgcaccgggactcaagggtgagcctgaggtacacgcgaggaggaaatggggagaacgccgtgagcctcgacaaaaaattgatgcccgtgcccgacggtcaccccgacgtgttcgaccgagaatggccgctgcgcgtcggcgacatcgaccgcgcgggccggctgcggctggacgcggcttgtcggcacatccaggacatcggtcaggaccaactgcgcgagatgggcttcgaggagacccacccgctgtggatcgtccgcaggaccatggtggaccttatccggccgatcgagttcggcgacatgctgcggtgtcggcgctggtgctcgggcacctccaaccggtggtgtgagatgcgagttcgtgtcgatggccgcaagggcggcctgatcgaatccgaggcgttctggatccacgtcaaccgggaaaccgagatgccggcccgcattgccgacgacttcctcgcgggtctgcaccggaccacgtctgttgatcggctgcgctggaagggctatctgaagccgggcagccgggatgatgcgtcggagatccacgagttcccggtccgggtcaccgatatcgacttgttcgaccacatgaacaacgctgtctattggagtgtgatcgaggactacctggcgtcgcatgcagagctgctgcggggccctttgcgggtgaccatcgagcatgaggcgccggttgcgctcggcgacaagctggagatcatctcccacgttcacccggctggttcgaccgagatattcggcccggggttggtcgaccgcgctgttacaacgctcacatatgtggttggcgacgagcccaaggcagtcgcctcgctgttcaatctgtgaccggatccgcaggacgtcgatccgtgggtttacctgcggatttgtcgttactggcgggtagcttctgaaacggttcagtttttgggcgacttcgcaaaatttgcaaaaagtccgcaggccgttgccgaaattcgcaagtgaaatgggtggaccagcgttgacacgctgtgccatggtcgagttagcacaccagtgaagctgcgccgttgacaccgcctggacgacggtagggcgtcagcgttttcggcaatgaaagaccgttaaggagttgtctatgtctgtcgtcggcaccccgaagagcgcggagcagatccagcaggaatgggacacgaacccgcgctggaaggacgtcacccgcacctactccgccgaggacgtcgtcgccctccagggcagcgtggtcgaggagcacacgctggcccgccgcggtgcggaggtgctgtgggagcagctgcacgacctcgagtgggtcaacgcgctgggcgcgctgaccggcaacatggccgtccagcaggtgcgcgccggcctgaaggccatctacctgtcgggctggcaggtcgccggcgatgccaacctgtccgggcacacctaccccgaccagagcctgtatcccgccaactcggtgccgcaggtggtccgccggatcaacaacgcactgcagcgcgccgaccagatcgccaagatcgagggcgatacttcggtggagaactggctggcgccgattgtcgccgacggcgaggccggctttggcggcgcgctcaacgtctacgagctgcagaaagccctgatcgccgcgggcgttgcgggttcgcactgggaggaccagttggcctctgagaagaagtgcggccacctgggcggcaaggtgttgatcccgacccagcagcacatccgcactttgacgtctgctcggctcgcggccgatgtggctgatgttcccacggtggtgatcgcccgtaccgacgccgaggcggccacgctgatcacctccgacgtcgacgagcgcgaccagccgttcatcaccggcgagcgcacccgggaaggcttctaccgcaccaagaacggcatcgagccttgcatcgctcgggcgaaggcctacgccccgttcgccgacttgatctggatggagaccggtaccccggacctcgaggccgcccggcagttctccgaggcggtcaaggcggagtacccggaccagatgctggcctacaactgctcgccatcgttcaactggaaaaagcacctcgacgacgccaccatcgccaagttccagaaggagctggcagccatgggcttcaagttccagttcatcacgctggccggcttccatgcgctgaactactcgatgttcgatctggcctacggctacgcccagaaccagatgagcgcgtatgtcgaactgcaggaacgcgagttcgccgccgaagaacggggctacaccgcgaccaagcaccagcgcgaggtcggcgccggctacttcgaccggattgccaccaccgtggacccgaattcgtcgaccaccgcgttgaccggttccaccgaagagggccagttccactagtctgccgagcagacgcaaaagcacccttttgcggcgcaaaagtggcgcttttgcgtctgctcgcgcatttgaggaggaacagtgagcgatgcgatccagcgggtaggggttgtcggggccgggcagatggggtccggcatcgccgaggtctcggctcgcgccggcgtcgaagtgacggtgttcgagccggccgaggcgttgatcaccgcgggacgcaaccgcatcgtgaagtcgctggagcgggccgtcagcgccggcaaggtaaccgagcgcgagcgtgaccgcgccctcggcctgttgaccttcaccaccgacctcaacgacctatccgataggcaactggtgatcgaggccgttgtcgaggacgaggccgtcaagtccgagatcttcgccgagctcgaccgggtcgtcaccgatccggacgcggtgctggcgtcgaatacctccagcatcccgatcatgaaggtcgccgcggccaccaagcagccgcaacgggttcttggcctgcatttcttcaatccggtcccggtgctgccgctggtcgagttggtgcgcacgctggtcaccgacgaagccgccgccgcgcgcacggaggagtttgccagtactgtgctgggcaaacaggtcgtgcgttgctccgaccgctccggattcgtggtcaatgcgctcctggtgccgtatttgctgtcggcgattcggatggtcgaggccgggtttgccaccgtcgaagatgtcgacaaggccgttgttgcggggttatcgcacccgatgggtccgctgcggctttccgatcttgtcggcctagacaccctcaagctgatcgcggacaagatgttcgaagaattcaaagaaccgcactacgggccccctccgctgttgctgcgtatggttgaggcgggccagttgggaaagaaatcgggtcgaggtttctacacgtactgaagtgtatgaacggcccccaggcttgacgcaaggcgagatcacagaccgagacggtgtggttacgatcgtgtgacagccgttgcgtacatcgggtagtatttccgcgatcaacagatgagaggttcggccggcatgactgagttaaggcccttttacgaagagtcgcaatcgatttacgacgtttccgacgagtttttctcactgtttctagaccccacgatggcttacacctgcgcgtacttcgagcgtgaggacatgactctcgaagaagcgcaaaacgcgaagttcgatttggcgctggacaagttgcatcttgagcccgggatgacgctgctcgatattggctgcggctggggtggtgggctgcaacgagcgatcgagaactacgatgtgaacgtcatcggtatcacgctcagtcgcaatcagttcgagtacagcaaagcgaaattggcgaaaattcccaccgaacgcagcgtccaggtgcggctgcagggctgggatgagttcacggacaaggtcgaccgtattgtcagcatcggtgccttcgaagcattcaaaatggagcgttatgcggcattctttgagcgttcctacgacatacttccagatgacggccggatgctgctgcacacaattctgacctatacgcagaagcagatgcatgagatgggcgtcaaggtgacgatgagcgatgtgcggtttatgaaattcatcggcgaagaaatttttccgggcggacagttaccggcgcaggaagacatcttcaaatttgcgcaggcggcggacttttcggtggagaaggtgcaattgctgcagcagcattacgctcggacgctaaacatctgggcggcgaatctggaggctaacaaggaccgcgccattgctcttcagtccgaggagatttacaacaaatacatgcactatctgaccggatgtgagcacttcttccgcaagggcatcagcaacgtgggacagttcacactgaccaagtagcccatcgccgcccgagcaccccaggggttgcggagctcacgccgggtgtggcttgacgcccgggcaccggccggtgggtagccagcgcgctttgtccggttacttttccagtgtgaactggtcgacgtcggtgtaaccctggcggaacagcttcgcgcagccggtcaggtacttcatgtagcggtcgtagacagtctgcgactggatcgcgatggcctgatctttgttggcctcgagcgctgtggcccacatgtccagcgtcctggcgtagtgcagctgcaatgactggaccgcggtgacccggaagccgaccttctcggcgtactcgtgcaccgtcgggatggacggcagccagccaccggggaagatctcggccaggatgaatttggtgaagtgaaccagttcgtgggtcaacgtcaggcccttttccctgccttctttgaaggtggggcgcacgatggtgtgcagcaacatcttgccgtcggccggcaacgtgcggtgggtcacctcgaagaaatggtggtagcgctggtggccgaagtgctcgaacgcgccgatcgagacgatgcggtcgacgggctcgtcaaatttctcccatccctccagcaacactcgtctggagcggggggtgtccatttggtcgaacattttctggacatgaccggcctggttctccgacaacgtcaggcccacgacattgacgtcgtatttctcgatggcgcgccgcatggtcgcgccccagccgcagccgatgtccagcaacgtcatcccgggttcgaggttcagcttgcccagggccaggtcgatcttggcgatctgggcctcctgcagcgtcatgtcgtcgcgttcgaagtaggcacagctgtaggtctgggtggggtccaagaacagccggaaaaagtcgtcggagaggtcgtaatgagcttgcacgtttccaaaatgcggcgtgagctgcacggacataccgattgagcctttctgtgttccgaggcccgcatccgcttgcctcgacgcacccctgatctatccccgatgcatcccttgcatgctagctgctgaaaggcggcccagtcgcaatcggcgccatgaccagctgtcgcagccgtcagcgaaaatcaccaggcgcgccgccaggcaccgatcgccaggcccacaaccagcagcgcaccggcctgacgcacgtgcagccaggccaacgcggcataccacagcggccacaccggaaacgccggtggcggctgctggggccgccgtcgcaggaaatagggccacactttcgccagccggggcagcgccccggcgaccagcaacgcggccagggcatggcagccagcatgacgtttacggcgataagtaggtagaagccgaccatcatggccagtgtcacggtgcgcgcgcacgtttcgccgagtagcaccggcagcgttcggatacccagcggttcgtcgtaaccgatcttgtcgatgtgcttacccatcagcaccgtggtgcacaacagcccgtaggggagcgacgccagcacgacctcccaaccgcccgcgcccaccgcggcgtagtaggttccagcgcacgctcgggtgagccgcagctggtggttcgtcgaggcgtggtatatgcggcacggttggccccggtagcggccgggtgctgggcatagcgggcgcgcgcgtaggtggcgctgtcagtaccgacatcggtgtcgtagagatcgttcataaggttgttggcgatgtgcggcgcatgtgattcccaccacaggacgagccagcgccaatccaagccaggctcgccgatcgccaacagccccgcgaccaggccggagaccagggtcatcggcagcactgcggcccgggtgacgacgagccaccgggtgaccgtgtcggtcggcccgtcagctggcgggttggtggtgcgaagtgcgtaggcccacgatctgagccgggagcccgcgcccgcgtcgggcatccctaaagcctagacctgcccccaggcaggcacgatcggcgaaggatgcggctgctcgcgaaacttctccaacgatccgccggcctcgacgatgccgcacagtgcgctccagctcagcatcgtcaggtagtcgatcagttcgtcactgctcatgcgcgggtctgacatccaggagtgggtggccagctgcacgccgcccacgatcagatatgcccacggctcgactccgccggtgtccatcccggcttcttgcatgcggcggcgcagcatcaccgcgagcatgcgggcaatgattcgctccgagtcggcaatcactttgcttttgctggccgagctattcgccatcacgaaccgatacggctccggttgggccgccacggtctcgacatagacccggatgatttcgcgggtcagttcgaaaccatccatatcggccgacagcgcagcgatcatgttggggatcaaggtggtctgcgtgaaccgcatcatcacggcggtcgtcaggtcgtttttgtcgacgaagtagcggtagagcacggtcttggagaccccgatctcggccgctatctcgtccatgctgaggaagcggccatgccggcgaatcgcctcaatcgtgccgtccaccagctcattgcggcgctccaccttgtgctggtgccagcgtcgcttgcgaccatccgtcttcacggtcacggccgggatacgctctgccactgttgccaattcccattcactagacgctcccgatactacggccaattgggggtcctgctggcacattggacgcgcgcgcggggtgcgcaggacagtgtcgtcacattaactggtgccggtgatagcggatgatggtgtggtggcacataaagccgaggtgtcgggctcgccgccgccacggctgaatttgagcacccagccgacggtggcgcggcgtgtccgcgcctccttcgcggaatccttcgccgcagccgatccggaggcggatgccgcccggcggatggcgctgcgtcggatgaaagtggtggcagtggggtttttggtaggcgccaccggcgtgttcctcgcttgtcgctgggcacaggccgatggcgctgaccacgcgtggctgggttatctgggcgctgcggcggaagccggtatggtcggcgccttggcggactggttcgcggtgaccgcgctgttcaagcatccgctaggcattccgatcccgcatacggcgatcatcaagcgcaagaaggatcagctgggcgagggcctgggcaccttcgtgcgggagaatttcctgtcgccgccggtcgtggagaccaagctgcgtgatgcgcagataccgagtcggcttggcaagtggttgtcagaggccacgcatgcccagcgggtggcggccgagaccgcaacggtgctgcgggtgctggtggagctgctgcgtgacgaggacatccagcaggtgatcgaccggatgattgtgcgtcgtatcgccgaaccgcagtggggtccgccggcgggccgggtgctggcgacgttgctggccgagaatcggcaggaagcctttatccaattgttggccgatcgggcgttccagtggtcgctcaacgccggggtggtgatccagcgggtggtggagcgtgactcgccgagttggtcgccccgattcatcgaccacctggttggcgaccgtatccaccgtgagttgatggaatttaccgacaaggtgcgccgcaaccccgatcacgagttgcgccgttcggctacccgcttcttgttcgatttcgctgacgacctgcaacacgatccggccactgtcgcgcgcgccgacgcgatcaaagaggagctaatggcgcgcgatgagatcgccactgcggccgcggcggcgtggaagacactgaagcggttggtgctcgagggtgttgacgacccgtccagtgcgttgcgcacccgcatcaccgatgcggtcatccggatcggcgaatcgcttcgtgacgatgccgacctgcgtgacaaggtagacagttggacggtgcgggcggcccaacatctggtctcggagtacggggtggagatcaccgcgatcatcaccgagacgatcgagcgctgggacgccgaggaagccagccggcgaatcgaactgcacgtcggccgagacctgcagttcattcggatcaacggaacagtggtcggggcgatggcagggttggcgatctatgcgatcgcgcaactgttgttctgacgggtgctaacaaacgcttgcaatagcaagcacttggacgtactctggtggccgttgcaccgatcaccccgagctaggagtagccaatgtcgtcggaggagaagctggccgccaaggtgtccaccaaggcctccgatgtggcttccgacatcggcagcttcatcaggtcgcaacgtgagacggcgcacgtctcgatgcggcagctcgccgagcggtccggcgtcagcaatccgtacctgagccaggttgagcgcggattgcgtaagccgtccgccgacgtgttgagccagatcgcaaaggcgctgcgggtctcggccgaagtcctttatgtgcgcgccgggattctcgagcccagcgagaccagtcaggtgcgtgacgccatcatcaccgatacggcgatcaccgagcgtcagaagcagattctgctcgatatctacgcgtcatttacccaccagaacgaagccacccgggaggagtgtccgagcgatccgacaccgaccgatgactagccgttggccggctgttttgcgcaccggctggcgggtaatcaaacctgaaggacagtcatctgggtgaggtcgaccgcaggctgatccagccgatcggccgcgctggccaacagcgactccgtcgatgacgtgcagcaaaggagacatgtagtgaccggatcagctgggcctgacatctacgaactcgaccgacaaccgacccgacgatcagaaggtttccccggcaagtcgcgtgccatgtcaatccgcgggtcttgactagtcctccctggaggagccgacgcttgccccaacgtccagaccaaagatgtaagaacgccgatatcagaaaatagttaatgaaaggaatacccatggctgaaaactcgaacattgatgacatcaaggctccgttgcttgccgcgcttggagcggccgacctggccttggccactgtcaacgagttgatcacgaacctgcgtgagcgtgcggaggagactcgtacggacacccgcagccgggtcgaggagagccgtgctcgcctgaccaagctgcaggaagatctgcccgagcagctcaccgagctgcgtgagaagttcaccgccgaggagctgcgtaaggccgccgagggctacctcgaggccgcgactagccggtacaacgagctggtcgagcgcggtgaggccgctctagagcggctgcgcagccagcagagcttcgaggaagtgtcggcgcgcgccgaaggctacgtggaccaggcggtggagttgacccaggaggcgttgggtacggtcgcatcgcagacccgcgcggtcggtgagcgtgccgccaagctggtcggcatcgagctgcctaagaaggctgctccggccaagaaggccgctccggccaagaaggccgctccggccaagaaggcggcggccaagaaggcgcccgcgaagaaggcggcggccaagaaggtcacccagaagtagtcgggctccgaatcaccatcgactccgagtcgcccacggggcgactcggagtcgacgtgttggatgcaaaccgcatagtctgaatgcgtgagccacctcgtgggtaccgtcatgctggtattgctggtcgccgtcttggtgacagcggtgtacgcgtttgtgcatgctgcgttgcagcggcccgatgcctataccgccgccgacaagctgaccaagccggtgtggttggtgatcctgggcgcggccgtggcgttggcctccatcctgtatcccgttttgggtgtgctcgggatggcgatgtccgcctgtgcgtccggcgtgtatctggtcgacgtgcggcccaagcttctcgagattcagggcaagtcgcgctaacggaatgaaagccctggtggccgtgtcggcggtggccgtcgtcgcactgctcggtgtatcttccgcccaagctgatcccgaggcggatcccggcgcaggtgaggccaactatggtggccccccaagttccccacgtcttgtcgatcacaccgaatgggcgcagtggggaagtctgcccagcctccgggtctacccgtcccaagttgggcgtacagcctcccgccgcctcgggatggccgctgccgacgcggcctgggccgaggttctcgcgctgtcaccggaggccgacactgccggcatgcgcgcgcagttcatctgccactggcagtacgccgaaatcagacaacccggcaaacccagctggaacctcgagccgtggcggccggtcgtcgacgactcggagatgttggcttccggctgcaatccgggcagccctgaagagtcgttttagtgctcggccaaccgactcgggcgcagttggccgcgctggtagaccacaccctgctcaagcctgagaccacccgtgccgatgtggccgcgctggtcgccgaagccgccgaactcggcgtctacgcggtctgcgtgtcgccgtcgatggtgccagttgcggtccaagccggtggtgtgcgggttgcggcggtgacgggcttcccgtcgggcaagcacgtgtcctcggtcaaggcgcatgaggcggctgcggccctggcatccggcgccagtgagatcgacatggtcatcgacatcggggctgcgctgtgcggtgacatcgacgcagtgcgctccgacatcgaggcggtgcgtgccgctgcggccggggctgtgctcaaggtgatcgtggagtcggcggtgctgttgggacagtcaaacgcgcacacgttggtggatgcgtgtcgtgccgccgaggatgccggtgccgacttcgtcaaaacctcgactgggtgtcatccggccggcggggccacggtgcgtgccgtcgagctgatggccgagacggtcggccctcggctaggggtcaaagccagcggtgggatccgcaccgccgccgacgcggtcgcgatgctcaacgccggtgccaccaggttgggcctgtccggcacccgggcggtgctcgatgggctcagctgacagctgagcgcgcgggtggcggcgtcaaatgtgcgagaagcagggattctggatgccggtggggatagccgcgtcgcgagttgagaaccggctcaccacgccggtcgaggtgacttgcacgctgtccgcgtgaatccccaacgggtagttcttggtcaggctggaggtgaactcgttcagcgtcgactgaacggtttctttcggcagcgagaacccgagcgtgttgaaattgatgatctgcagctccaatcctttgccagccactatcggcttggctgtgatgttgttcagcaggcccttcagttcgacggtgccgtctgcggggtgagtgaccacgctgctggtgacgaaagcgcccaggatcggaatcgcgttttgcaccgattccttgatgccttccgacgaccaggtaatggtggcgtccagggcgccgatcgtgcccctagagttgggggtgttcttgagccggacgttctggatcgtgagctttatctgcatgcccttggcatcgcggatctgattgcccgcggtttccaccgagatattggtgaagtgccgcgtagcgacctgccacagcagcagcggcgccacaccgaaggatgcggtggcttggtctttgaccacgcatgcgaccgcttgggcgaccttgctattggcaacatggcgagcgtatagctcgcctccgatcagcccggcgaggacgagcgaaaacacgatgatcaggacaagaaagacggttagcgggtcgcggcgggcacgtcgtttggtcttcaccgccgctggctcttcctcttgcgcagccagcaggcccgttgggtcccacgcctggtgcgcagcttggcggccggatcgccgtgtgtgggcatgcgacgcagccagatgctcagtttgcggctgctgctccggttgggtgggcggactcaccggttcttggatatgacccgcgggctcgccggggcgcagtcgaccggtggatgcttcggacgatgccgggggtcgggcgagcggaccttgatccccagggcgcgcccagggcgacgggtcgttcggtggaccttgcgggttggtcacccacgcgattgtgccttatcgatctgaacgaagtctgtctggttgcgtagcaccgcaatgcggtcgcgagccgcggccacattgtcgacatcgatgtcggcgaccagcagttgcggctgggtgccagctgacaccaccacctcgcctagcggcgaggccaccaggctgccgcctaccccggtcggtgcagccgagctcgcccccacgccggtgcgggcatcacctgggtctgcttggccggccgcggcgacgtaactcatggagtctagcgcccgggcgcgggccagcaacgtccactgttcgagtttgcccggaccggaaccccaggatgcacagaccgcgatcagttgggccccgcgccgcgccagctcggtataaagggcgggaaagcgaatgtcgtagcaaacggtcaaacccacccgcacgccgtcgaccacgactaccaccggttcgcgcccgggtgcgacggtacgtgactcggtgaagccgaacgcgtcatagaggtggatcttgtggtagtgcgcgtccggctgattgggcgtgcccgggccggctgcgatcagcgtgtttgttacccgcccgtcgccggtcggggtgaacatgccggcgatcacggtgatgcccgcctcggtcgcgatccgtcggactccgtttgcccagggtccgtcgacgggctcggcgacctgccgcagcgggacaccgagccggcacatggtcgcctcaggaaacaccaccagctgtgcgcccgcggtggcggcttcgccggcgtacttgccgaccagttgcagattggcggcggggtcggtaccgctgcggatttgcgccaacgcgattcgcatgcgcgccagcctaggcccggcgacgagcgcgccgcaccggcgcgcgcaggagccgggcaatccagcttgcgcccggcgacgagcgcgccgcaccggcgcgcgcaggagccgggcaatccagcttgcgcccggcgacgagcgcgccgtaccggcgcgcgcaggagccgggcaagctggcacctcagacgttgttcgtgatccacagcgtggtgaagcgctgttcgatggtcactagctggcttaattgggtgccgataagcctctccagcttcccgccaatgaacgggatacgcacctggatggtgacctgcagcgtcattcgggagccacccgactccggtatgggcgagagcacggcggtgccccacaagttcaccggagcgtccacgatcgatcccgcaatggacgcggtcgcgatgccttccttgaccgggccccaggtctcctcgcgccgtaccgaaagatcgccccggtgcaactgtgtgaccaggccgggcagattgtgactgcgcaccatctgcagggtgacgacttcgatggtgccgtcgtctccggagtcgccacctacgcgtatcgactcaagggtcgcgacgtcgaccggcgtttcggccagtctggctttccagtagtccgcctcgtagaaagcccgatgaacctcctcgacgctgccctcgtagtcggccgacatgtcgaatgaacgcggcatagcaggtcaggctacccttacgggccatgaaacggagcggtgtcggttcgctctttgccggtgcgcatattgccgaggcggtcccgttggcgccgctgaccactttgcgtgtgggcccgatcgcccgacgtgtcatcacttgcaccagcgccgaacaggtggtggctgcgctgcggcacctggattcggcggccaagaccggagctgaccgcccgctggtgtttgctggtggctccaatttggtgatcgccgagaacctgaccgacctgaccgtggtgcggttggccaatagcggcatcaccatcgacggtaacttggtgcgggccgaggccggtgcggtcttcgatgacgtggtggttagggccatcgaacagggtctgggcggactggaatgcctgtctggcatcccaggatcggccggggcgacacccgtgcagaacgtgggggcgtatggcgcggaggtgtctgacaccatcactcgggttcggcttttggatcggtgcacgggtgaggtgcgttgggtatccgcgcgcgacctgcgcttcggctatcgcacgagcgtgctcaaacacgctgatgggcttgcggtgcccaccgtggtcttggaggtggagtttgcgctggatccgtcgggccgcagcgcaccgctgcgctacggcgagctgatcgccgcgctgaatgcgaccagcggcgagcgcgccgacccgcaagcggtccgcgaagcggtgctggccctgcgggcacgcaagggcatggtgctggacccgaccgaccatgacacctggagcgtgggatcgttcttcacaaacccggtggtcacccaggatgtttacgaacggctggccggtgacgcggccaccagaaaggacggtccggtcccgcactatcccgcgcccgacggcgtcaagctggccgccggctggctggtggaacgggccggcttcggcaagggctatccggatgccggcgccgccccatgccggctttccaccaaacatgcgctggcgctgacaaatcgtggcggggccaccgccgaagatgtggtgacgctggcgcgcgccgtgcgcgatggggtccatgatgtgtttggtatcacactaaaacccgaacccgtgctgatcggctgcatgttgtagctgcgttttcgcggcggggcggcgtggcgcgcattgcttagggctggttgccaggcgttctgtggtcattcgtgtgctgtttcgcccggtatctttgatacccgtgaataactccagcaccccccagagtcaggggccgatcagtcggcgtctggcgttgacggcccttgggtttggggtgttggcaccgaacgttctggtcgcgtgcgccggcaaagtgaccaagctggccgagaagaggccgccaccggcgcctcgtctgactttccggcctgccgactctgccgccgacgtggtgccgatcgcgccgatcagcgtcgaggtcggtgacggctggtttcagcgggtcgcgctgaccaattcggcaggcaaggtcgtcgccggggcatacagccgggatcgcaccatctacacgatcaccgagccgctgggctacgacacgacctacacctggagcggttcggccgtcggccatgacggcaaggcggttccggtggcgggcaagttcaccaccgtggcacccgtcaagacgatcaacgcgggattccagctcgccgacggccagaccgtcgggatcgcggcgccggtgattattcagttcgattcaccgatcagcgacaaggccgccgtcgagcgggcactaaccgtgaccaccgacccgcctgtcgagggcggctgggcctggctgcccgacgaggcgcagggcgctcgcgtgcactggcgtcctcgggagtactacccggcgggtaccaccgtcgacgtcgacgccaagctgtatgggctgccgttcggcgacggcgcgtacggcgcgcaggatatgtcgttgcacttccagatcggtcgtcgtcaggtggtcaaggccgaagtctcgtcgcaccgcatccaagtcgtcaccgatgccggcgtcatcatggacttcccgtgcagctacggcgaggccgacttggcgcgcaacgtcacccgcaacggcatccacgtcgtcaccgagaaatactcggacttctacatgtccaacccggccgccggttacagccatatccacgaacgttgggcggtgcggatttccaacaacggcgagttcatccatgccaaccctatgagcgccggtgcccagggcaacagcaatgtcaccaacggctgtatcaacctgtcgacggagaacgccgaacagtactaccgcagcgcggtctacggtgacccggttgaggtgaccggcagttcgatccagctgtcctacgccgacggtgacatctgggactgggcggtggactgggacacctgggtgtcgatgtcggcgctaccgccaccggcggccaaaccggcggcgacgcaaatcccggtcaccgccccggtcacgccgtcggatgcccccaccccgtccggcacacccacgactactaacggaccgggtgggtagcgcgacggctagctgatgcctggtcgcggggccggatgacgatctggtcaaggttgacgtgtgagggccgggtggccacgaatccgatcacctcggcgacgtcggcggctactagcggtgtcatgccggcataaaccgcgtccgcgcgttgctggtcgccgtcgaagcggaccagcgaaaattcggtctcgaccgcacctggagcgatctcggtgagccggaccggcttccccagcagttcgccgcgcagcgtgcgatgcagcgcgccctgcgcgtgcttggcagcggtgtagccggcgccgccgtcgtacacctcgatcgcggcgatcgaggtgacggtgacgatcaggccgtcgccggagtcgatcagcttgggcagcagcgcgcgggttacccgcagcgtgcccagtacgttggtgtcccacatccatcgccagtgctccaaatcggcatcggcgacgaactgaagccccttggcgccaccggcgttgttgaccagcacgtccacccggctcagcgcgcgggccaacgcttcgacggcggcgtcgtcagtgacatcggccacaattgcggttccgccgatctggttggccagcgcggtgatccggtccgcccgacgcgccaccgcgaccacgtgaaacccctgggccgcaagggttctcgcggttgcctcgccgataccggaactggcgccggtgaccacggcgactcgcttgcgggtgccgattgtcgtcatcgggacaactctaataaacgtgctaaattctcggtgtgtaccacagcgccttgttccgcacgacgaccgcgtgtcttttcgcgggcgcgtgttgttgccgccccctttgccgcgcctgaccgatacacgtcagcaggtgtggccaacaggacccggccattggaactcggagaagaacgcccgtgtactcgactaaccgcacctcacagtcactcagccgcaagcccggccgcaagcaccagctgcgatcgcaccgttacgtcatgccgccgtcgctgcacctgtccgattccgcggctgcgtccgtcttccgggccgtgcgtttgcgtggtccggtcggtcgggacgtaattgctggatctacgtcgctgagcatcgcgacggtgaaccgccaggtcatcgcactgctggaagcgggcctcctgcgtgagcgggcggacctggcggtttccggggctatcgggcgcccacgcgtgcctgtcgaagtaaaccacgagccttttgtcaccctgggcatccacatcggtgcccggaccaccagcatcgtggccaccgacctgttcggccgcacgctcgacacggtggagaccccgaccccgcgtaacgctgccggggccgcgctgacctcactggccgacagcgctgaccgatacttgcagcgctggcgccggcgccgtgcgctgtgggtcggggtgacgcttggtggtgcagtcgacagtgccaccggtcatgtcgaccatccgcggctcggttggcgtcaggctccggtcggacccgtgctggcggatgccctaggcctgcccgtgtcggtggcgtcccacgtcgacgccatggccggggccgagctgatgctcggcatgcggcggttcgcaccgagctcgtcgacgagcctctacgtctacgcccgcgaaaccgtaggctatgcgctgatgatcggtgggcgggtgcactgcccggccagtggtcccggcaccatcgcgcccctgcccgtccactctgaaatgctcggcggtaccgggcagctggagtccactgtcagcgacgaggcggttttggctgctgcccgccggctgcggatcatccccggcatcgcttcgaggacccggaccggtgggtccgctaccgccatcaccgacttgctgcgagtggcacgagccggtaatcagcaagccaaggagctgctggcggagcgggcccgcgtgctcggtggggcggtcgcgctgctgcgtgacttactcaatcccgacgaagtggtggtgggtggccaggcgtttaccgaatatcccgaggcgatggagcaggtggaggcggcgtttacggcagggtcggtgctggcgccgcgtgacatccgcgtgaccgttttcggcaaccgggtgcaggaggccggggcaggcatcgtgtccctaagcgggctctatgccgatccattgggtgccttgcggcgatcgggcgcgctggatgcccggctgcaggacaccgccccggaggcgctcgcgtgatcggctgacgagccgcgtccgcgcgtgtcacttcggttcctgcaaggatggcaggtgtgcggcacgatgacggttcagggttgatcgcccagcgccgtccggtccgcggcgagggtgccacccgctcgcgcggcccatccgggccatccaatcggaatgtttcggcagcagacgacccgcgccgggttgcgctgctggcggtgcacacctcaccgctggcacagccgggcaccggtgacgccggcggcatgaacgtctacatgctgcaaagtgcgctgcacctggcccgtcggggcatcgaggtggagatcttcacccgggccaccgcatcggcagatccaccggtggtgcgggtggcacccggggtgctggtgcgcaacgtggtggcggggcccttcgagggtttggacaagtacgacctgcccacccagctttgtgcgttcgccgccggggtgctgcgcgccgaggcggtccacgaaccgggttactacgacatcgtgcactcgcactactggctgtcgggtcaggtcggctggctggcgcgcgaccgctgggcggtgccgttggtgcacaccgcacacacgctggccgccgtgaagaacgcggcactggccgacggcgacggacccgagccgccgctgcgtacggtcggggagcagcaggtcgtcgacgaggcggatcggttgatcgtcaacaccgacgatgaagccaggcaagtgatttcgcttcatggtgccgatccggcacgaatcgacgtggtccatcccggtgtcgatctggacgtgttccgcccgggtgatcggcgcgcggcccgggccgcgctaggactaccagttgacgagcgcgtggtggccttcgtcggacgcatccagccgctgaaggcacccgacattgtgctgcgtgcggccgccaagttgcccggggtgcgcatcatcgtggccggcggaccgtcgggcagcggtctggcttcaccggacggactggtccggctcgccgacgaactgggcatctctgcacgggtgacgtttctgccgccgcagtcccacacggatctggccaccttgtttcgggcggcggacctggttgcggtgccgagctactccgagtcgttcggcctggttgctgtggaggcccaagcgtgcggcacaccggtggtggccgcggcggtgggcgggctgcccgtcgcggtgcgcgacgggatcaccggcaccctggtgtccgggcacgaggtcggtcagtgggccgacgccatcgatcacctgctgcggttgtgtgccgggccacggggacgggtgatgagccgggcggcggcacggcacgccgccacgttctcgtgggagaacaccaccgacgcgctgttggccagttatcggcgtgcgatcggcgagtacaacgccgagcgccagcgccggggcggcgaggtgatatcggacctggtagcggtgggcaagccccgccactggacgccgcgtcgcggggtgggcgcgtgacttcctccttgccgaccgtgcaacgtgtgatccagaatgcgctcgaggtcagccagctgaagtactcccaacacccccgcccgggcggggcgccgcccgcgctgatcgtcgagctgccgggcgaacgcaagctcaagatcaacaccatcctgagcgtcggcgagcattcggtgcgtgtcgaggcgttcgtgtgtcgcaagcctgacgagaaccgcgaagacgtataccggttcctgctgcggcgcaaccgccgcctgtatggggtcgcgtacacgctggacaatgtcggcgacatctacctggtgggccagatggcgctgtccgcagtggacgccgacgaggttgaccgggtgttggggcaggtgttagaggtggtggattcggacttcaatgcgttgttggagttgggatttcggtcgtcgattcaacgagagtggcagtggcggttatctcgcggtgagtcgctgcagaacctgcaggccttcgctcacttacgcccgacgacgatgcagagcgcgcagcgcgatgagaaggagttgggcggttaggtcgagcccgacgacgatgcagagcgcgcagcgcgatgagaaggagttgggcggttaggtcgagcccgacgacgatgcagagcgcgcagcgcgatgagaaggagttgggcggttaggtcgagcccgacgacgatgcagagcgcgcagcgcgatgagaaatagcactcgtggaggtcaagacgcccgccggtgatgggctggtggcgctcaccccgttccggactcagaaattcgcgatcacaatttgcgcgttcaagtcattggcatgcatgtgatggtttagcgttccgctgtgcctcttcaggtgtttgtcggcttcgttgccatgatgacgctcaaggtcgcgatcggcccgcaaaacgcatttgtcctgcgccaaggaattaggcgagaatacgtgctggtcattgtggcgctgtgcgggatcgctgatggggcactgattgccgcgggcgttggcggcttcgctgcgctgattcacgctcatcccaatatgactttggttgcccgatttggcggcgcagcgttcttgattggctacgcgctattggccgcgcggaacgcgtggcgcccgagcgggctggtgccgtcggaatcggggccggctgcgctgatcggcgtggtgcaaatgtgcctggtggtgacctttctcaacccacacgtctatctggacactgtggtgttgatcggtgccctcgccaatgaggaatcagatctgcggtggtttttcggagccggtgcctgggccgccagcgtcgtatggttcgccgtgttgggatttagcgcgggccggctacagccattcttcgcaactccagctgcttggcgcattcttgatgcgctggttgccgtgacgatgattggggtcgccgtcgttgtgctcgtcacgtcaccaagtgtgccgacggccaatgtcgcactgatcatttgaccacctcgtaggccgcccatgtatcggccttggtgaaccggccgttacggtgccgaccacctcggcggtatgaacgcgctgcgcagcggaccgaggagaattcgggcattttggtccacgatgaggagtgcgggagtgcgtgagagacttgccggtatggcaaacactggcagcctggtgttgctgcgccacggcgagagcgactggaatgccctcaacctgttcaccggctgggtcgatgtcggcctgacggacaagggccaggcagaggcggttcgaagcggcgagctgatcgcggaacacgacctattgcccgacgtgctctacacctcgttgctgcggcgcgcgatcaccaccgcgcatctggcgttggacagcgccgatcggctctggattcccgtgcggcgtagctggcggctcaacgaacgccactacggcgcgctgcagggtttggacaaggccgagaccaaggcccgctatggcgaagagcagttcatggcctggcggcgcagctatgacacgccgccgccgccgatcgagcggggcagtcagttcagccaggacgccgaccctcgttacgccgacatcggcggtggcccgctcaccgaatgtctggctgacgtggtcgcccggtttttgccatatttcaccgacgtcatcgttggcgacttgcgggtcggcaagacggtgctgatcgttgcccacggcaactcgttgcgcgcgctggtcaagcacctggaccagatgtctgacgacgaaatcgtcggactgaacatcccgaccggaattccgctgcgctacgacctggattccgcgatgaggccgctggtgcgcggtggtacgtatctggacccggaggcggcagccgccggcgccgccgcggtggccggccagggccgcgggtaattgtttgagatcccacctgccggcggtttcggcggctgatggtgtgctttggtgcgctgtttgccaaacagcatgtgaacggtaaccgaacagctgtggcgtagtgtgtgacttgtccgattttggccttgccgcgctagggcgacgttcaccggatttgtaggattttccttgtgactgtgttctcggcgctgttgctggccggggttttgtccgcgctggcactggccgtcggtggtgctgttggaatgcggctgacgtcgcgggtcgtcgaacagcgccaacgggtggccacggagtggtcgggaatcacggtttcgcagatgttgcaatgcattgtcacgctgatgccgctgggcgccgcggtggtggacacccatcgcgacgttgtctacctcaacgaacgggccaaagagctaggtctggtgcgcgaccgccagctcgatgatcaggcctggcgggccgcccggcaggcgctgggtggtgaagacgtcgagttcgacctgtcgccgcgcaagcggtcggccacgggtcgatccgggctatcagtgcatgggcatgcccggttgctgagcgaggaagaccgccggttcgccgtggtgttcgtgcacgaccagtcggattatgcgcggatggaggcggctaggcgtgacttcgtggccaacgtcagtcacgagctcaagacgcccgtcggtgccatggctctactcgccgaggcgctgctggcgtcggccgacgactccgaaaccgttcggcggttcgccgagaaggtgctcattgaggccaaccggctcggtgacatggtcgccgagttgatcgagctatcccggctacagggcgccgagcggctacccaatatgaccgacgtcgacgtcgatacgattgtgtcggaagcgatttcacgccataaggtggcggccgacaacgccgacatcgaagtccgcaccgacgcgcccagcaatctgcgggtgctgggcgaccaaactctgctggttaccgcactggcaaacctggtttccaatgcgattgcctattcgccgcgcgggtcgctggtgtcgatcagccgtcgccgtcgcggtgccaacatcgagatcgccgtcaccgaccggggcatcggcatcgcgccggaagaccaggagcgggtcttcgaacggttcttccggggggacaaggcgcgctcgcgtgccaccggaggcagcggactcgggttggccatcgtcaaacacgtcgcggctaatcacgacggcaccatccgcgtgtggagcaaaccgggaaccgggtcaacgttcaccttggctcttccggcgttgatcgaggcctatcacgacgacgagcgacccgagcaggcgcgagagcccgaactgcggtcaaacaggtcacaacgagaggaagagctgagccgatgacctgcgccgacgacgatgcagagcgtagcgatgaggtgggggcaccacccgcttgcgggggagagtggcgctgatgacctgcgccgacgacgatgcagagcgtagcgatgaggtgggggcaccacccgcttgcgggggagagtggcgctgatgacctgcgccgacgacgatgcagagcgtagcgatgaggtgggggcaccacccgcttgcgggggagagtggcgctgatgaccagtgtgttgattgtggaggacgaggagtcgctggccgatccgctggcgtttctgctgcgcaaggagggctttgaggccacggtggtgaccgatggtccggcagctctcgccgagttcgaccgggccggcgccgacatcgtcctgctcgatctgatgctgcctgggatgtcgggtaccgatgtatgcaagcagttgcgcgctcggtccagcgttccggtgatcatggtgaccgcccgggatagcgagatcgacaaggtggtcggcctggagctgggcgctgacgactacgtgaccaagccctattcggcacgcgagttgatcgcacgcatccgcgcggtgctgcgccgtggcggcgacgacgactcggagatgagcgatggcgtgctggagtccgggccggttcgcatggatgtggagcgccatgtcgtctcggtgaacggtgacaccatcacgctgccgctcaaggagttcgacctgctggaatacctgatgcgcaacagcgggcgggtgttgactcgcggacaactgatcgaccgggtctggggtgcggactacgtgggcgacaccaagacgctcgacgtccatgtcaagcggctgcgctccaagatcgaagccgacccggctaacccggttcacttggtgacggtgcgcgggctgggctacaaactcgagggctagcggacgccgacaaccttggcgactgtctggtcggctacggccagtgccatcgccatgatggacagctgcgggttcacttccgggcagctgggcaggatcgaggcgtcggcaacccacacgccctcgacgccgcgcagccggcccgtcgcgtcgaccggacaaagctgctcgtcggcgccggcggccgcggtgcccgtcggatggaaggcggccaggtgcaggcttctggggttggctcggcgcagcacatcctgcagctcgggcagggaccgcatcggtggggcgccggggataccggtcagcacctccaccgcgccggcggcaaagagcagccggccaatggcctgcagcgcgacccgtagcttggcgatctcacctggagctatgtcatagcgcaccaccgtctcgccgcgcaccgaccgcaccgtgccgacgccccgatcggccaccatcgccccgaatgttgcgatctgcggcgcccggtcgagccagcggagcagctcggccccgtagccggggaagaccatcgaccccatgcccggcggtgtggaggtggcctcgatcagcacgccgtcggattcgtgaaactcgtgaaccgccgcgctctgcagcaccccgcgccacgcgaagacgtcgtcgtcgaagagcccggccagcatagttgccgggtgcagcgcaaggttgtggcccagtcgcgggtgcccaccaagaccgctgcgccgcaacagtcctggcgtctccgtcgcaccggcggcgacgacgaccgcgtcggccagcacgtcgagtgtggtgccgtcgggccggcgggctcgcacgccataggcccgcccggcgcggtgcaggatccgttcgacccgcgcccaggagatgatccgcgcgccggccgcgcaggcttgcggcagggcgttgaggtgcacgccgaacttggcgttgctggggcagccgatcgcgcactggcaacagccacggcaccccggcgcattgcgcgggatgggcgccgcccgccagcccagcgacttggcggcctgcagcaacaggcgcccgttgcggcccatgatctccagcggcaccggcgcaacccgcagtgtttgctccgcatcgtcaagacgacgtcccagctggtcggggtcggccaggccgagaccgaactcgtcacgccagcgccgctgcacggcaagtgaaggccgaaagcaggtgccggagttgacgacggtggtgccgcccaccgcccggcccatcggcagcaccaccgccggtcgcccgagcgcgacggtggccccggcgccacggtacaacccggcataacggtcgaccgggtgggtgctacggaactcctcgaccgtccagcgccgtccctcttcgagcacgaccacgtcaaggccggcccgggccagcgtgcgcgcgaccatcgcgccgcccgccccggagccgacgaccaccgcatcggccctggtgacggatgggctgtccgccgacaagatgacggtcaactccgcgtcggggcgcgccgcgtcatgttcctgggcgcgggcgagcaattcgtgcgcgtaggtgtcggcgccgttggccaacagcacgatcgccttcaacccctccacggccgcagcgacttccgggctcagtgcggcgatccggtgcagcacccgtgcccgctcgtccgggtgcagtcgcggtagcgaccggccggtggtgaggtagctggccgccgccagtgaagccagcccggcgcgcaccgcgaatcgtgaggtcgccggcagtcgtgtgacgtagcggtcaacgcgctgcacgaattgagccggcaacgggccgccgagctccggcggcagcagcgcggcgccgaacgaggccaacggataggacttagcccgatcggcgagccggctcatatccggcgcccgagccggcggccgagctttatgaagaacggatacgttgcgaagatggcagcggccatcgcgtgcagcggccactccgcgcgggccacatccacgctgaaaaccccgctgttccacatgaaatcgcggccgttctgtgcgcgaaatggccgccacagcatcccgagcccgggtacgttgtggtacagcccgaacgaagcgccgaagaagacgcccagggcggcggcctcggcggcatcgcggcggtccacgggcaggcgtcgctcgatgagcactccgcagacaaacagcagcggcgggtcgagcaggaaactcatgctggcgtcccttccttgatagccggtgccgcggttccccgcaggccgacttcggcgtgtccggtgcccagcaccgaccagtgccggccgccgagctcgatgtggatgtcggcctgctcggtgttggtgcacaccgccttggccccgtcgggatcggtgtatcccaggcttacgcaccgctccggcggctggtctacccggattagcgcctcccggccgccgatgcgtccttccagttgccagtgccgcacgccgagcgttgtccgcattcgcagcgacggtaaaggacttgcgggccaatcctttccgtcgatgcggaagcgaacgaacgctagcggcgcgagcctgcgtaggcccggcttgtgtgataccgcggtcaccacctctaggacgtcgccgtcgccgagatcggcatggatccatccccaccgcttggcattgccatgtccgtagatgtgggccacactgccgcgccagctgtcgacgcggtgggtggtttcgccgacggccaaggagccagcgaagacggcggtgggtgcgatcaccacttgggcgccgggcagcaactcgcgctcccaggccacgcgaggaaacgtccacagtggcgccgcggtgtccttccaggacagctcccatgcgagtgatcgggtacgtccggtcagctccgctggcgccattcgtacaccggcgatgtcgaaccaggcggggccggccgcgggttgggcgggctgggggccgaagcgctcggtgcccggcggggcatccggtggaaaccaggtcacccagccgtgcgcgtagggcccgccggtcgtcggggccaccgtctcacagtgcacccataggccggtacgcgtcagtggatccgacagagtcgcataccagacttccaggcgcccggctgcaccgcgccaccgcggcaaggccgccgaccgcgtttcatcgtccactgcggcacctcctgctggctgagttgtcgattcgcccactatattggttgagccaatgaaccagtcaagtgtctttcagccgccggatcggcagcgggtggatgagcggatcgcgacgacgatcgccgacgccatcctcgacggcgtcttcccgccgggctcgaccctgccgcccgagcgagacctggcagagcggctcggtgtcaaccgcacctcgctacgccagggtctggcgcgactgcaacagatgggcctgatcgaggtgcggcacggcagcggcagtgtggtccgtgaccccgaggggctcacccatcccgcggtggtcgaggcgctggtgcgcaaactgggccccgacttcctcgtcgagttgctggagatccgcgcggcgttaggcccgttgattggccgcctggcggccgcccggagcacgcccgaggatgccgaggcgttgtgtgcggcgctggaagtggtgcaacaggcggacacggccgcggcgcggcaggcagccgatcttgcctacttccgggtgctcatccacagcactcgcaaccgcgcattggggttgctctaccgctgggtggagcacgccttcggcggccgcgagcatgcgctcaccggggcctacgacgacgcggacccagtgttgaccgacctgcgggcgatcaacggggcggtgctggccggtgacccggcggccgctgccgcgaccgtcgaggcgtatctgaacgccagtgcgctgcgcatggtcaagtcctaccgcgaccgcgcttagctactgggccgcacgcgtcgccggatgtacggcgatgagccctaattgactgcggcgcttgcacattgctgcgagttccccataggccttctccccgagtaattcggtgagttcgtcggcaaggctctgccacacctgcttggttccgacatgggcggccggatcgccggtgcaataccagtgcaggtcagcaccacccgagccccaaccgcggcggtcatattcggtgagggtggtcttgaggatttcggtgccgtcggggcgggtcacccattcctggctgcgccggatcggcaactgccagcagacatcgggtttcatcgtcaacggcggcacgcccagcttgagggctttgctgtgcagcgcgcagccggcgccaccggcgaacccgggccggttcaagaagatacacgcgcccttgtgtttgcgggtgcggtgctggggttggccgtcgtgctcgtcgagttccaggtagcccttgcggcgcaggccctttgcccggaactgccagtcgtcgtcggtcagcttgtgcaccgcgtcggccaaccgggtgcggtcgtcgtcgtcggacaggaacgcaccgtgcgaacaacagccgtcgtttggccggcccgcgacggtgccctggcaggcgggtgtgccgaatacacacgcccagcgcgacagcaaccaggtaaggtcggccgcgatcaggtgctcgggattgtccgggtcgtagaactccacccactcacgggcgaagtccaactcgacttcttgccccgggtgcaccggtctccgtcgcgaatttgccacggattcaacgttagaccacgaagcccgccgcgggattccgccatagcccagcacggccggcacatgccaccgggcgccttgcgcgggtcgccacacgcccgtatcttcgcccggctagtttgttttcgtgcgattgggcgtgctggacgtgggtagcaacacggtccatctgctggtggtcgatgcccaccgcggcggccacccgaccccgatgagctcgacgaaggccacgctgcggctggccgaggccaccgacagctcgggcaagatcaccaagcgcggagccgacaagctgatttccaccatcgacgaattcgccaagattgccatcagctcgggctgtgccgagctgatggccttcgccacgtcggcggtccgcgacgccgagaattccgaggacgtcctgtcccgggtgcgcaaagagaccggtgtcgagttgcaggcgctgcgtggggaggacgagtcacggctgaccttcctggccgtgcgacgatggtacgggtggagcgctgggcgcatcctcaacctcgacatcggcggcggctcgctggaagtgtccagtggcgtggacgaggagcccgagattgcgttatcgctgcccctgggcgccggacggttgacccgagagtggctgcccgacgatccgccgggccggcgccgggtggcgatgctgcgagactggctggatgccgagctggccgagcccagtgtgaccgtcctggaagccggcagccccgacctggcggtcgcaacgtcgaagacgtttcgctcgttggcgcgactaaccggtgcggccccatccatggccgggccgcgggtgaagaggaccctaacggcaaatggtctgcggcaactcatcgcgtttatctctaggatgacggcggttgaccgtgcagaactggaaggggtaagcgccgaccgagcgccgcagattgtggccggcgccctggtggcagaggcgagcatgcgagcactgtcgatagaagcggtggaaatctgcccgtgggcgctgcgggaaggtctcatcttgcgcaaactcgacagcgaagccgacggaaccgccctcatcgagtcttcgtctgtgcacacttcggtgcgtgccgtcggaggtcagccagctgatcggaacgcggccaaccgatcgagaggcagcaaaccatgacgggaccacaccccgaaacagagagctccggtaaccggcagatctcggtggccgagttgctggccaggcaaggggtcaccggcgccccggcccgacggcgccggcggcgacgcggcgatagtgacgccatcacggtcgccgagctgaccggtgagattccgatcattcgtgacgaccatcaccacgccggcccggacgcgcacgcgagccagtctccggcggctaacgggcgagtccaggttggcgaagctgccccacagtcgccggcggaaccagtcgccgagcaggttgccgaagagccaacgagaaccgtgtactggtcgcaacccgagccgcgctggcccaagtcccccccgcaggaccggcgcgagtccgggcccgagcttagcgagtacccgcggccactgcgccacacgcatagcgacagagcacccgcggggccgccgtccggtgccgaacacatgagtccggatccggtcgagcactaccccgatctctgggtggatgtcctggacaccgaggtgggcgaagcggaagccgagaccgaggtgcgcgaagcgcaacctgggcgcggcgagcgccacgccgcagcggcggcggccggcaccgacgtcgagggtgatggtgcggccgaggcgcgggttgcccgtcgtgccctggacgtggtcccgacgctgtggcgcggcgcgttggtcgtgctgcagtcgatcctggccgttgccttcggtgccgggttgttcatcgccttcgaccagttgtggcgctggaacagcatagtggcgctagtgctatcggtgatggtcatccttggcctagtggtctcggtgcgggcagtccgcaagaccgaagacatcgccagtacgttgatcgcggttgcggtgggggcgctgattaccctgggaccgctggccttgttgcaatcgggctagccgccaccacacacagtgcgcccagcaatcaaagtcggcttgtcgacggcctcggtgtacccgttgcgggccgaggccgcgttcgagtacgccgacaggcttggctacgacggggtcgagctgatggtctggggtgaatcggtcagtcaggacatcgatgccgtccggaagctgtcgcgccgctaccgcgtgccggtgttgtcggtgcacgctccgtgcctactcatctcgcagcgggtgtggggcgccaatccgatcctcaagttggaccgcagtgtgcgggccgccgaacaactgggcgcgcaaacggtcgtcgtgcatccgcctttccgctggcaacgacgctacgccgaagggttcagcgatcaggttgccgccctagaagcggccagcaccgtgatggtggccgttgaaaacatgtttcccttccgagcggaccggtttttcggggccggccagtcccgggaacggatgcgtaagcggggtggtggcccaggtccggcgatctcggcgttcgcgccgtcctacgacccgctggacggcaaccacgcgcattacacgctggacctctcgcacaccgcgactgcgggcaccgactcgctggatatggcgcggcggatgggcccagggctggtgcacctgcacctgtgtgacggcagcggcctgcccgccgacgagcacctggtgcccggccgcggtacccagccgaccgccgaggtgtgccagatgctggccggcagcggcttcgtcggccacgtcgtgttggaggtgtccacctcaagcgcgcgttcggccaatgaacgcgaatccatgctggccgagtcgttgcagttcgcccgcactcacctgctgcgttgatatgccgggaacactatgaacgcgttgttcaccacggcgatggcgctgcgcccgcttgactccgatcccggcaatccggcgtgccgggtttttgaaggcgagctgaacgagcactggaccatcgggcccaaggtgcacggcggtgcgatggtggcgctgtgtgccaatgccgcccgcaccgcttacggcgcggccggacagcagcccatgcggcaaccggtcgcagtgtcggcgagctttctgtgggcgccggatccggggacgatgcggttggtgacgtcgatccgcaagcgtggtcgccggattagcgtggccgatgtcgagctcacccagggtggccgcacagcggtgcacgccgtggtcaccctgggtgagccggagcattttctccccggcgttgatgggagcggcggggccagtggaaccgcgccgctgctgtcggcgaatccggtggtggagctgatggcaccggaaccgcccgagggagtcgtgccgatcggtcccggccatcagctggccgggctggtgcacttaggcgaaggctgcgatgtccggccggtgttgtcgacgttgcggtccgcgaccgatgggcggccaccggtgattcagctgtgggcgcgtccacgcggcgttgctccggacgcgctgttcgctctgttgtgcggggacttgtcggccccggtgaccttcgcggtggaccgcaccggctgggcgcctacagttgcgctcaccgcctatcttcgggccctgcccgccgacggctggctgcgagtgctctgcacctgcgtcgaaatcgggcaggactggtttgacgaggaccacatcgtcgtcgaccggttgggccgcatcgtggtgcagacgcgccaactggcgatggtgcctgcccagtagcacggatcggccgagctgtctgcgatgcttttcggcatggcaaggatcgcgattatcggcggcggcagcatcggtgaggcattgctgtcgggtctgctgcgggcgggccggcaggtcaaagacctggtagtggccgagcggatgcccgatcgcgccaactacctggcgcagacctattcggtgttggtgacgtcggcggccgacgcggtggagaacgcgacgttcgtcgtcgtcgcggtcaaaccagccgacgtcgagccggtgatcgcggatctggcgaacgcgactgcggcggccgaaaacgacagtgctgagcaggtgttcgtcaccgtggtagcgggcatcacgatcgcgtatttcgaatccaagctaccggctgggacgccagtggtgcgtgcgatgccgaacgcggcggcattggtgggagcgggggttacagcgctggccaaaggccgctttgtcaccccgcaacagcttgaggaggtctcggccttgttcgacgcggtcggcggcgtgctgaccgttccggaatcgcagttggacgcggtgaccgcggtgtccggctcgggtccggcctatttctttctgctggtcgaggccctggtggatgccggagtcggggtgggcttgagccgtcaggtggccaccgatctcgccgcgcagacaatggctggctcagcggcgatgctgctggagcggatggagcaagaccagggtggcgccaatggcgagctgatggggctgcgcgtggaccttaccgcatcacggctgcgcgccgcggttacctcgccgggcggtacgaccgccgctgcgctgcgggaactcgaacgcggcgggtttcggatggctgtcgacgcggcggttcaagccgccaaaagccgctctgagcagctcagaattacaccggaatgattcacgaattttgaactgattatccctcaccagtaccagtaaccccactagtcccgctattctcctctttgtaagcgcgtgtgggtgccagcggaggggaagccgctgggactgcgcgtgcctgacacgattgggttgcgatgacgtctacgaacgggccatcggcgcgggataccggttttgttgagggccagcaggccaagacacaacttctcaccgtggccgaagtggcggccctgatgcgggtgtccaagatgacggtgtaccggctggtgcacaatggcgaactgcccgcggttcgggtcgggcggtcattccgggtgcatgccaaggccgtccacgacatgttggagacttcgtacttcgacgcgggctagttgccggccgcacgcggccggagtccgcctgaccgatctggcaatgctcgggcgctgccggtttggtgttccgtgcgaccgcccgggtagagtgtccgggtcagatagccgtatagatggcggggtcatgggttcagtaatcaagaagcggcgcaagcgcatgtccaagaaaaagcatcgcaagctgctgcgtcgcacccgggtgcagcgcaggaaactgggcaaataggttgcgagcagaccccgccagctcgaccgtcacgcgcttgtaacgccgccgtttcgcctggccgttaggctgtcggagtgagttcgtcgaacgggcgcggtggcgccggaggagtcggcggcagcagtgagcacccgcagtaccccaaagttgtgctggtgaccggtgcttgccgtttcctaggcggctacctgaccgcacggcttgcccagaacccgctgatcaaccgggtcatcgcggtggacgcgatcgcgccgagcaaggacatgctgcgccggatgggccgagccgaatttgttcgcgctgatatccgaaacccattcatcgccaaggtgattcgcaatggcgaggtggacacggtggtgcacgccgcggcggcctcgtatgcgccgcggtccggcggcagtgcggcattgaaggaacttaacgtgatgggcgcgatgcaactgttcgccgcctgccaaaaggcgccctcggtccgccgggtcgtgctgaagtcgacctctgaggtttacggatcgagcccacacgatccggtgatgttcaccgaggacagcagcagtcgacgtcctttcagccaaggtttccctaaggacagtctcgatatcgagggctacgtgcgcgcgctgggccgacgccgccccgatattgcagtgactatcctgcggctggccaacatgatcggcccggcgatggacaccacgctttcacgatatctggccgggccgctggtcccgacgatcttcggccgtgatgcgcgactgcagttgctgcacgagcaggatgcgctgggtgcgttggagcgcgcggcgatggccggcaaggccggaacgttcaacatcggagccgacggcatcctcatgctgtcgcaggcgatccggcgggccgggcgaattccggtgccggtgccagggtttggggtatgggctctggattcgctgaggcgagcgaatcactacaccgagctgaatcgtgagcaattcgcttacctgagttatggccgggttatggacaccaccagaatgcgcgtcgaactgggttaccagccgaagtggacgaccgtcgaggcgttcgatgactattttcgcggccgcggcctgactcccattattgacccacatcgggtacgctcctgggagggtcgcgccgtaggtttagcgcagcgctggggtagccgaaatccaattccatggagcggactcagataggtttggatgggtaacgtggcgggcgaaaccagagcgaatgtcattccactgcacacaaatcggagccgggtagcggcgcgcaggcgtgccggtcaacgggcagagtcccggcagcatccgtcgttgctgtccgatccaaatgaccgggcgtcggccgagcagatcgccgccgttgtccgggaaatcgacgaacaccggcgcgctgcgggtgccacgacctcgtccaccgaggccacgcccaacgaccttgcgcaactcgtcgccgcggttgctggatttctccgacagcgcctgaccggtgactacagcgtcgacgaattcgggttcgacccgcacttcaacagcgccatcgtacgacccttgctgcgattcttcttcaagtcatggtttcgggtcgaagtcagtggtgtcgagaacatcccgcgcgatggtgcggcgctggtggtggccaatcacgcaggtgtgttgccgtttgacgggttgatgttgtcggtggccgtccacgacgagcacccggcgcatcgggatctgcggctgcttgccgccgacatggtgttcgacctccccgtgatcggcgaagccgcccgcaaggcgggtcataccatggcgtgtacgacggatgcgcaccggttgcttgcctccggcgaactcaccgcggtgttccccgagggatacaaggggctgggtaagcgtttcgaggaccgttaccggttacagcggtttggtcgcggcggcttcgtatcggccgcgctacggaccaaggcgccgattgtgccgtgttcgatcatcggctccgaagagatctaccccatgctgaccgatgtcaagctgctggctcggctgttcggcctgccgtacttcccgattacgccgttgttcccgttggctggaccggtcgggctagtgccgttgccctcgaaatggcgcatcgcgttcggtgagccgatctgcaccgccgactacgcctccaccgacgccgacgacccgatggtgacgttcgagttgaccgatcaggtgcgcgagacgatccagcagacgctataccgactgcttgccggccgtcgcaacatctttttcggctgacccttatttgaccagagtgaactggcagacgtccgtgtacttgtcgcggaacaggtctgagcagccacgtaggtagtgcatgtagatgtcgtacgtctcctggcccttgagggcgatcgcctcatctttgtgcgcctgtagcgcatccgcccaggcgttcagggtcggcacgtagttggccccgatccggtggtagcgctcgaccttccatccggcgttggaggagtaatagtccacctgcgagatcctgggcagccgcccgcccgggaagatctcggtcaggatgaacttgatgaagcgcagcaggctcatcggagacgtcaagcccagctcctgggcttcctctttgtccgggatagtgatggtgtgcagcagcatccggccgtcgtcgggcgtcaaattgtagaacttcttgaagaaggtgtcgtagcgctcgaacccggcgtccccggcaccgtcggcgaaatgctcaaacgcaccgagtgacacgatgcggtcgaccggctcgtcgaactcctcccagccctggattcgcacctcttttcggcgggggctgtcgacctcatcgaacatcgccttgtcgtgggcgtactggttttcgctcagggtcaagccgatgacgttgacgtcgtactcggcgaccgcgtgtcgcatggtggaaccccagccgcagccgatgtcgagcagcgtcatgccgggctcaaggttcagcttgtccagtgccagcttgcgcttcgcgtactgcgcctcttccagcgtcatatcgggacgttcgaagtaggcgcagctgtacgtcatcgatgggtcaagccagagcttgaagaactcgttcgatttgtcgtagtgggatcgaactgcttcgaccggcggcttgagctgcgtgccgcttgtcgtgtcgccctgtgacgtcattgaacggaccctactttccccactagatcgatgcaatcgccgccaccgttgcatcggcatcggcttcgtggtgggccgcttctcccaacatggtgacgacactggtgaccacaggctttccttcggcgtcggtaacttcgcttcggatctcggcgagcaccgtgccgtgggattcgatgacggagtcaagataggtgtcgaagtacagcttgtcgttggccaggatcggccggtggaagcggaacttctggtcgcgatgaaagacccgggcgatgttgatcgggatattgaacttggtgaagatctccagctgcacgcgccggccggcgatcgccaggaaggtcagcggggctaccagcgcggggtaaccggccgctgcggcatccggctcgctgtagtgggtcgggtggtcgtctttgaccgcgaccgcgaactcgcggatcttctcgcgccccaccagaaagtggtccggcgcccgataatgcttgccgatcagtgtctgggcttcttcgggaactgtcatgccgctgccgccctccgctcgaatagttgctaagccctattgcccggctcctcctcgccccgctgcgcgggtcgcatcgtcgccaggctgggccctattgcccggctcctcctcgccccgctgcgcgggccgcatcgtcgccaggctaacggcgcagcttatcagcgtgattggcgtctagaggctagagccgccaacgcgccgccggccgcacccagcgccagggccgacggaaccccgatccgagcggccttgcgggcgattcggaaatcacggatctcccacccccgttcccgggccaggctgcgcaggcgggcgtcggggttgatggcgaccgcggtgcccaccagcgacagcatcgggacgtcgttgtagctgtcggagtaggcggtgcagcgtttgagattgagtccctcccggatggccagcgaccgcaccgcgtgtgccttgccggtgccgtgcaggatctcgccgaccagtctgccggtgaatatcccgtcgaccgactcggcgacggtgcccagggcgccggttaggccgagccggcgggcgatggtggccgcgagttcgtatggggtagcggtgatcagccatacctgctggccggcgtccaggtgcatctgggtgagttcgcgggtgccgtcccagatcttgtcggcgatgatctcgtcgtaaatctcctctcccaaggccaccaactccgcgacggatcggccctcgatgaacgcgagcgccttgcgccggccagcggcgacgtcgttgctgttctccttgccaagtagctggaacttggcctgagcgtaaagaaatccgaggacgtcgcggtaggtgaagtagtggcgagcggctagcccgcggccgaagtgcaccgccgacgagccctgaaccaaggtgttgtccacgtcgaagaaggcggctgcggtcaggtcgatcggcggctgccgatcgctgccggcggcggcgacgggggccggcatgtccaccggcgagtggctggcgctggcatcgggtggcggcgggtcggccggcgaagccaggtcgacgtgaccggcctggtctgggctacccaggtgggaggaaaccatcattactcctaatcgcggtgcctgcccggtggccgatgctgcggccgttatcaaccctatccggcaaatgcgcggcggagctcttggctggcgcggattgatctgcaagcccagcgcggtatcgaaattcgcgaggccgcagcgactttcgtcgtgaacacgacccgcagcggttcggggccaacatgtcagccccataccggtacgcgcaaagctgggtacgtgaaatcctgaattcttcagcctgtcaacggtagcgtctacgctagctaacgcaacgagacatccgattactacgcacgttaggacatttcaggaggtatcgggaggcctaagggtcactaggtccgcgcgatgggcggaacacgagggtgaggatgatttcggttagcggcgccgtgaaacgcatgtggttgctgctggccatcgtcgtggtggccgttgtcggggggcttggtatctatcggctgcacagcatcttcggtgttcacgagcaacccactgtcatggtcaagcctgatttcgacgtcccgctgttcaaccccaagcgggtgacctacgaagtctttggccccgccaagaccgcaaagatcgcctacctggaccctgatgcccgggtgcatcgactcgatagcgtgtccctgccgtggtccgtcacggtcgagacgacgctgcccgcggtcagcgtcaacctcatggcgcagagtaacgccgacgtgatcagctgccggatcatcgtcaacggcgccgttaaggacgaaaggtctgagacctcgccgcgagcgctaacctcctgccaggtgtcatccggatgagcgaaagacacgccgcactgacgtcactgccgcccattctgccgcggctgatccgccggtttgcggtggtgatcgtcctgctctggctgggcttcaccgcctttgtcaatctcgccgtaccgcaactggaagtggtcggaaaagcacactcggtatcgatgagccccagcgacgccgcatcgattcaggcgatcaagcgcgttggtcaggtgttcggtgagtttgattccgataacgcggtaacgatcgtgctggaaggcgaccagccactcggtggggacgcgcaccggttctatagcgatctgatgcggaagctttccgccgatacccgccatgtcgcgcacatccaggacttctggggggatccgctgacagcggcgggatcccaaagtgcggatgatcgggccgcctacgtcgtggtgtacctcgtcggtaacaacgaaaccgaagcgtatgactcggtccacgcggtgcggcacatggtggacaccacaccgccaccgcacggggtgaaggcctatgtcaccggtccggcagcactcaatgccgaccaggccgaggccggagacaaaagtatcgctaaggtcaccgcgatcacgagcatggtgatcgcagcaatgttgctagtgatctatcgctccgtaattaccgcggttctcgtcttgatcatggtcggcatcgacctcggcgcaatccgcggattcatcgccttgctcgccgaccacaacattttcagcctttcaacatttgcgaccaacctgctcgttctcatggcgattgcggcgagcacggactacgcgatattcatgctcggccgttaccacgaatcgcgctacgccggcgaggatcgggaaacggccttctacacgatgtttcacgggaccgcccacgtgatcttgggttcgggtttgaccattgccggcgccatgtattgcctcagctttgcccggcttccgtattttgaaacgctcggcgcgcccattgctatcggcatgctggtcgcggtcttggcggcgctcacgctcggcccggccgtactgaccgtgggcagcttcttcaagctgttcgatcccaagcggcggatgaacactcggcggtggcgccgggtgggaacggcaattgtgcgttggccggggccggtgctcgcggcgacatgcttggtcgcctccattggcttgctggccttgcccagttaccggacaacgtatgatctgcgcaagttcatgcccgccagcatgccgtccaatgtgggggatgcggcggctggtcgacgcttttcacgggctcggctgaaccctgaggtgctgttgatcgagactgaccacgatatgcgtaatccggtggacatgctggtgttggacaaggtagccaaaaatatctaccacagtcccggtattgaacaagtgaaagcgataacccggcccttgggaacaaccatcaagcacacttcgataccgttcatcatcagcatgcagggcgtgaatagtagcgagcaaatggaattcatgaaggaccgaattgatgacatactggtgcaggtggccgcgatgaatacctccatcgagacgatgcatcgcatgtatgcactcatgggcgaggtcattgacaacaccgtcgacatggatcatctcacgcatgatatgtcggacataacggctacgctaagagatcatctcgcggatttcgaggatttcttccggcctattcgcagctacttctactgggaaaaacattgtttcgacgttccgctctgctggtcgataagatcgatattcgatatgtttgacagtgtggaccagctgagcgaaaagctcgagtacctggtcaaggatatggatattctgattacactgttgccgcagatgcgcgcgcagatgccgccgatgatatctgcgatgacgacgatgcgggacatgatgcttatctggcatggcacgcttggcgcgttctataagcaacaggagaggaataacaaggaccccggcgcgatgggccgggtttttgacgccgcccagatcgatgattcgttctatctgccgcagtcggcttttgagaatccggatttcaagcgggggctgaagatgtttttgtctccggacggcaaggcagcccgctttgtcattgctctggagggagatcccgcaacgcccgagggcatctctcgggtcgagccgatcaagcgggaggctagagaggccataaagggaactccattgcagggcgctgcgatctatctgggtggcaccgcggcgacgttcaaggatattcgagagggcgccagatacgatctgctgatcgccggagtggcggcgata

SEQ ID NO: 649 - DNA, 45191 bp, Mycobacterium tuberculosis
aagcttgccgcgccggtgggtgtccgctcggattgcctgggcgtcgacgcgccgttgccggcctgggccgagtccagcacttcgcactatgtgcagaccaaagacccggtggtcgccgcgctgcggcagcggctggcaacggcgccggtgatcaccgagtggtgcgagttgccgaccggcagttcgccgcgggcttactacgagaagggcctgcgcgacgtcatcaggtatcacgtgtcgatgacgtcgagcgttaacttccccgaccagacggcgacctcgccgatggaccccgcgttgtacctggtgtgggcgcaagctaacgccgccgcaggctatcggtactcggtcgaagcgcagccggggtcgcaagcgctagcgggcaaggtcgcgacgatctcggtcacctggaccaactacggcgctgctgccgccaccgaaaagtgggtgcccggctaccggctggtggattccaccggacaggtggttcggacgctgccggcagcggtggacctgaagacgctggtctccgaccagcgcggcgatcgcagcagcgaccagccgacaccggcgtcggtcgccgagacggttcgcgttgatctgtccggcttgcccgcgggccactacacgctgcgggccgcgatcgactggcaacagcacaaaccgaacggctcccatgtggtgaactatccgcccatgctgttgtcccgcgacggccgcgacgattccgggttttatcccgtcgccacgctcgacatcccacgcgacgcgcagaccgcggtcaacgcttcgtaggtggctttcccgtcgctgcggtccgctcacttgccttcgggtggttgcggcggctggtagcggggaaataccccggtgggcggcggcagcgctgtgccgggggtcagccgaacacctacggcggcgaacgaccgctggtttggggcctggccgagcaggtccaaaattttgccggccgactccggcatcaccggctggatcagcagtgccgcgatgcggactacctcgcaggtgacgtagagcgtggtgcggaaccgggcctgatcggcttcggactcgctcttgcgcagtacccacggctgctgcaccgaaaagtacttgttcgcgtcgccgagcatcagccagatcgcctccagcgccaggtgcatcgcctgtgcgtcgaagtgaccgcgcactcgctccaacaagccatcggcggtcgcaagcagcgcggcgtcggcgtcggcgaactcacccgggttgggcaccctgccgtcaaggtttttggccaccatcgacaacgagcgttgggccaagttgccgagctcgttggccagatcggtgttgatccgagtgacgatggcctcgtcgctgtaactgccgtcctggccgaacgggacctcccgcaacaggaagtagcggacctggtccaccccgagcgcttccgccagggcaaccgggtcgacgatgttgcccaccgatttactcatcttctcgccgcggttgtgcaagaacccgtgcgcgaagatccttcgcggcaactcgattccggctgacatcaaaaacgccggccaatagacggcatgaaacctgatgatgtccttgccgatcatgtgcaaatcggcgggccagtagcggcggaacaactccgagtcggtatccgggaagcccgccccggtcaggtaattggtcagcgcgtcgacccagacgtacatgacgtggtcggggtgctcgggcacctgcacaccccagtcaaacgaggtgcgcgagatcgacaggtcgtccaggccgccggagacgaagctgatcacttcgttgcgccgcgtctccggcgcgatgaagtcggggttggcgtgatagtgggccagcagcttgtcggtataggccgacagccggaagaagtaggtctgctcctcggtccaggtcaccggcgtgccggtctctaccgtcaggcgcgtgccgtcgacaagttgggtctccgattcgacgaagaaccgctcgtcgcgcaccgagtaccacccggaatagttgtccagatagatgtcgccggccgccgacatccgtcgccagagttccttggacgcctcgtggtggtcggcatcggtagtgcggatgaatcggtcgaaggagatgttcagcgcctcctgcatgcgctgaaacacgtcggaattgcgccgggcaagcgccgcggtgggcacgcccgctgccgcggcggcttgtgcgaccttcaggccatgctcgtcggtcccggtcaggaagcgcacgtcatagcgatccagccgtttgaaccgggcgatcgcgtcggtggcgatgtattcgtaggcgtgacctacgtggggtgcagcgttgggatatgcgatcgcggtggtgacgtaatagggcttcatttcgacaccaccctattgtgtgcgggtgagctccgaccgcccagccagacgagatccaccgcccgctccggaacccctggcgccgttggtcgacgcccacacccatctcgacgcgtgcggtgcacgagacgccgatacggtgcggtcgctcgtcgagcgagccgccgcggccggcgtgaccgcggtggtcaccgtcgccgacgacctggagtccgcgcgctgggtcacccgcgcggccgaatgggatcggcgagtctatgccgcggtggcgttgcacccgacccgcgccgatgcgctcaccgacgctgcccgtgccgagctcgagcgattggttgcccaccccagggtggtggccgtcggtgagaccggaatcgacatgtactggccgggtcgcctggacgggtgtgcggagccgcacgtccagcgggaggcctttgcctggcatatcgatctggccaagcggaccggtaaaccgctgatgatccacaatcgtcaggccgaccgcgacgtgctggacgtgctgcgggccgagggcgcgccggacaccgtgatcttgcactgcttctcgtcggacgcggcgatggcccgcacgtgtgtggacgccgggtggctgctcagcctgtccgggacggtgagcttccgtaccgcccgtgaactacgggaagccgtcccgctgatgccggtggagcagcttttggtggaaaccgatgcaccgtatttgaccccgcatccccaccggggcttggcgaacgaaccgtactgcctgccctataccgtgcgggcgctggctgaactggtcaatcggcgccccgaagaggtggcgctcatcaccacaagcaacgctcgccgagcttatgggctagggtggatgcgccaatgagcgcgccgagcggcccataacacccgcgcgccggagttgctcaacattggccggttcgttaccgtcttgtgatcgaacgggtggggcctctaggtttcggagggcccattttgctttttgttcgctgtgtaggtggttgagtgttgccgaggtcggggatatagcgcgttgactctacttaccaaacttcatcagacccaatcaccgatgttgcgcctggtagtcggtgcgctgctgctggtgttggcgttcgccggtggctatgcggtcgccgcatgcaaaacggtgacgttgaccgtcgacggaaccgcgatgcgggtgaccacgatgaaatcgcgggtgatcgacatcgtcgaagagaacgggttctcagtcgacgaccgcgacgacctgtatcccgcggccggcgtgcaggtccatgacgccgacaccatcgtgctgcggcgtagccgtccgctgcagatctcgctggatggtcacgacgctaagcaggtgtggacgaccgcgtcgacggtggacgaggcgctggcccaactcgcgatgaccgacacggcgccggccgcggcttctcgcgccagccgcgtcccgctgtccgggatggcgctaccggtcgtcagcgccaagacggtgcagctcaacgacggcgggttggtgcgcacggtgcacttgccggcccccaatgtcgcggggctgctgagtgcggccggcgtgccgctgttgcaaagcgaccacgtggtgcccgccgcgacggccccgatcgtcgaaggcatgcagatccaggtgacccgcaatcggatcaagaaggtcaccgagcggctgccgctgccgccgaacgcgcgtcgtgtcgaggacccggagatgaacatgagccgggaggtcgtcgaagacccgggggttccggggacccaggatgtgacgttcgcggtagctgaggtcaacggcgtcgagaccggccgtttgcccgtcgccaacgtcgtggtgaccccggcccacgaagccgtggtgcgggtgggcaccaagcccggtaccgaggtgcccccggtgatcgacggaagcatctgggacgcgatcgccggctgtgaggccggtggcaactgggcgatcaacaccggcaacgggtattacggtggtgtgcagtttgaccagggcacctgggaggccaacggcgggctgcggtatgcaccccgcgctgacctcgccacccgcgaagagcagatcgccgttgccgaggtgacccgactgcgtcaaggttggggcgcctggccggtatgtgctgcacgagcgggtgcgcgctgaccatccggctgctcgggcgcactgagatcaggcggctggccaaagagctcgactttcggccgcgcaaatctctcggacagaacttcgtgcacgacgccaacacggtgcgacgggtggttgccgcctccggggtcagccgttccgacctggttttggaggtcgggccgggcctgggatcgctgaccctggcactgctcgaccgcggcgcgaccgtcaccgcggtcgagatcgatccactactggcttctcggctgcaacagaccgtggcggagcactcgcacagcgaggttcaccgactaacggtggtcaatcgcgacgtcctggccctgcgccgggaggatctagccgcggcgccgaccgcggtggttgccaatctgccgtacaacgtagcggtaccggcgttgttgcatctgcttgtcgagttcccgtcgatccgtgtcgtgacggtgatggtgcaggccgaggtcgccgaacggctcgccgccgagccgggcagcaaagagtacggcgtgcccagcgttaagctgcgcttcttcgggcgggttcgccgctgcggcatggtgtcgccgaccgttttctggcccattccgcgtgtctattccgggctggtacgcatcgatcgatatgagacctcgccctggcccaccgacgacgcttttcgacggcgggtattcgaactcgtggacatcgcattcgcgcagcggcgcaagacttctcgcaacgcgtttgtgcagtgggcgggctcgggaagcgagtcggcgaatcgattgttggcggccagcatcgaccccgcccgtcgcggtgagacgctgtccatcgacgacttcgtgcggctgctgcgacggtccggcggctccgacgaggccaccagcaccggccgggacgccagggcgccggacatttcggggcacgcgtcggcgagctgacggggcgccgccgcgtgtggtcggcgcgtcacagcgatagtctgctgcggtgtccgcatctgacggcaacaccgctgaattgtgggtgcccaccgggtcggtcaccgttcgggtgcccggaaaggtcaacctctatctggcggtcggcgatcgccgcgaggacggctatcacgagctgaccacggtatttcatgccgtctcgctggtcgacgaggtaaccgttcgtaacgctgatgtgctctcgctcgagttggtcggcgagggggccgaccagctgccgaccgacgaacgcaatctcgcctggcaggcggccgagctgatggccgaacacgtgggccgggcgccggacgtctcgatcatgatcgacaaatccattccggtcgccggcggcatggccggtggcagcgcggacgctgcggcggtcctggttgcgatgaactcgttgtgggaactcaatgtgccccgccgcgacctgcgcatgctcgccgcgcggctaggcagcgatgtgccgtttgccctgcatggtggtaccgcgctggggacgggtcgcggcgaggagttggccaccgtgttatcccgcaacaccttccactgggtcctggcgttcgccgacagcgggttgctcacctccgcggtgtacaacgagctcgaccggctcagggaggtgggggatccgccccggcttggtgagcccgggccggttctggctgccttagctgcgggtgatccggatcagctggcgccgttgctgggtaatgaaatgcaagcggccgcggtgagcctggacccggcgctggctcgtgcgttacgcgccggtgtggaggccggcgcgctcgcaggcatcgtgtccggttcgggtcccacgtgtgccttcctgtgcacctcggcgagctcggcgatcgatgtcggcgcgcagctgtcgggggcgggagtttgtcgcaccgttcgagtcgccaccgggccggtacccggcgcccgcgtggtgtctgcgccgaccgaagtgtgaccgaattcttgggagcatgcctcgggcggccaggggtatccgcgcgtgccgaggccggtgggtcgatcggctggcgcaccagcatgccagcggtagggccgcaggcatccgccctcgcgaggtcggtggcgcgcatcaaagccaggcgcaaaagccataccatgatgcgacagagccgctcggcgagagcctccgctaccggccagctcacggcgatagctgcatcaacggccatcgagacaacccgtcggcacgggaatcctcgcagttcaccgcggggagtacggcaaaggctgtgaccaagctgtgacatcgccctcaaacctcggcagagtttggcagctacttaagagttgcttaagataatccgcggtgttgggtcgtgggctcatcaccgaaccgagacccaaccgctccccaactgtgtgcgcgcgcctgtcgcgatgtggcatccggtaggcggaccatgaaaacccggaccttggggacagcaccggaaccgaggaggttgccttgagcaggttcaccgagaagatgttccacaatgcccgcaccgcgacgacgggcatggtcacaggtgaaccgcacatgcccgtccgccacacctggggcgaggtccatgagcgtgctcgttgcatcgcgggcggcctggccgccgcgggtgtcggtcttggtgacgttgttggggtgctggccggcttcccggtggagatcgcccccacggcgcaggccctgtggatgcgcggggccagcctgaccatgctgcaccagcccacaccgcgcaccgacttggccgtgtgggccgaggacaccatgaccgtcatcggcatgatcgaggccaaggccgtgatcgtctccgagcccttcctcgtggccattcccatccttgagcagaaaggcatgcaggtccttaccgtcgctgaccttttggcgtcggatccgatcggccccatcgaggtcggcgaggacgacctggcgttgatgcagctgacgtccggatctaccggctcccctaaagccgtccagatcacccaccgcaacatctactccaacgccgaggcaatgttcgtcggcgcccagtatgacgtcgacaaggacgtcatggtcagctggttgccctgcttccatgacatgggcatggtgggcttcttgactatcccgatgttcttcggtgcggagctggtcaaggtcacgccaatggacttcctgcgcgacacgctgctgtgggcgaagctcatcgacaagtaccagggcaccatgaccgcggcgcccaacttcgcctacgcgctgctcgccaagcggttgcggcgccaggccaagcccggcgacttcgatctgtcgaccctacgcttcgcgctgtccggcgccgagcccgtcgaacccgccgacgtcgaggacctgctcgacgcgggcaagccgttcggcctgaggccctcagcgatcctgccggcctacggcatggccgagaccacgctggcggtgtccttctcggagtgcaacgccggcctcgtcgtggacgaggttgacgccgacctgctggcggctctgcgccgggccgttcccgccaccaaaggcaatacccgcaggctggccacgctaggtccgctgctgcaggacctagaggcccgcatcatcgacgaacagggcgatgtcatgcccgcccgcggcgtgggtgtcatcgagctgcgcggcgagtcgctaactcccggctacctgactatgggtggcttcatcccggcccaagacgagcatggctggtacgacacgggcgacctcggctacctcaccgaggagggccacgtggtggtatgtggccgcgtcaaggatgtcatcatcatggccgggcgcaatatttacccgaccgacatcgagcgggcggccggccgcgtcgacggcgttcgtccgggttgcgcggtggccgtgcgtctcgatgccggacattcgcgcgaatcctttgccgtcgcggtcgagtcgaacgccttcgaggatcccgccgaggttcgtcgcatcgagcatcaagtggcccacgaggtggttgccgaggtcgacgtgcggcctcgcaacgtcgtggttcttggacccgggaccattccgaagacgccgtcgggcaagctgcgtcgggccaactccgtcaccctggtcacctaaggccgccgagcagacgcaaaatcccctcgacacgccggttgcgaggggattttgcgtctgctcacgcgggtcgttaccaggcgtggacgcggttttgtgcgggctccatgccctgttcgataagcagctcggtggcatcggcggcctgctcgcagatcgtggggacctcggcgcgctcggccggggtaaagttctccaacacaaacgccgccgggtccttgcggccgggcgggcggccgatcccgatacgcacccgctgaaagtctttggtacccagcgcggccaccaccgagcgcaacccgttgtggccgccttcgccgccgccgatcttgagccggatgcggccgaactcgaggtcaaggtcgtcgtggatgacgatgatgttggccggcgccaccgagtagaacttcgccagcggccctatctggcggccggactcgttcatgtagcagcgcggcttggccaaaaccagggagcgcccggctgatctaccagtggcgacttcggcgccggaacgcttgtgtgccttgaacttcgcgcctagtcgcgcggcgagcagatcggcgaccacgaacccgaggttgtgccgggtacgggcgtaattggctccagggttgccgaggccgaccacgagcaacggctcggccatgtcgcaagccgtctactcggactcgccagcggcctcggcttcgccggcttctaccgcggcttcctcggcttcctcggctcctgcgacttcgccctccagctcctcggcggttggcgccttcaccacgttgaccaccaacagatcagggtcagaaatcaggctgacaccggccggcagcgcgatctgcccggcggtgagctgggtgcctggttcggcaccttcgatggacacggtcaactgctcgggaatcgacagcgcctcggcctcgatctcgatgctgttggtctcttgggtgaccagggtgtcgggtccggcctggccctcgacgaccacgctgacttcgacgacgaccttctcgccacggcgcacgaccagtaggtcggcatgctggatggtgcggcggatcggatggatatgaagtgccttggtcagtgccagctgttccttaccggcgatgtcgagggtcaacaccgcgttggtgccggaatgccgcagtacggccgcatagtcgtgtccgggcagctccaggtgctgtggctcggcgccgtggccatacagcacagcgggtatcttgccggcgcgccgggcccgccgggacgcgcccttgccggtctcggtacgcaccgtgacgcgcagctggttgcttgcggatttggccatatgtcgctcctgggtggctcggttacctcgtttgggggcacggccagggtcgcgacagcttgtcggcctccgtcgataacggtgttctgccggcctgctgtagaccgccgaccaccctcgccgtgacgcccggctaggctaacccatggctactgcattggggaaattcgatccttgtgagctgctcggatagctgtgccccaaccgtgcggacaattactttgccgcgacgacgaatccggcgatgatcgcctcgatgtcggaagcgtgcttgacggcctcgttggccagactcgtgatggtgagctgcaccaggtagcgctgcttggccggcggtgcgccggttgggaagacgatccggttccaggtgtgcagtcgcctgccgtgcaggtcataactgccctgaatcatcgaggacggaaacccgttgaagtctgccgtcgaggagtccaattcggtgaagttcgtcgacagccgggcatcggcagtgccatgcttgagcgcttcggcgatatcgaagtcccggtgcagcttgaacaccatgagcatggccgttggatagctttcgcccttggcgatcatctccgtgttcggggtgatgttcggatttttcatcggtgcccagcccggtggtgtcggaatcgacacggtcaggtcggtcaggctgctcggtgccaccggctctccggtgacgccgacgctttccagatacttccacagcgggaccggcacttccgtcgtggtcgagacggcgctggtggttgggctcgtggacaaaatcgactggaagtcaggcgatttcggtccgcaagcgaccgctgacattgccagcgtggctaccgcgaccgcgaccgccaagggtctcacagaatcttgcggacagcgtcgaccggccaagcccgccggatgccctcaaggatgacggctgccatctatgcgtccccgtcgaaaagtcctgttactgagccgttttcgaagaccgcccggattgtgctggccagcagcggcgcgatggacaaaacggtgagctgggggaagcgcttgtcttcgccgatcgggagcgtgttcgtgacgatcacttcgcgggcgccgcaggaggccagccgctgcgcagcggggtcggagagcacgccgtgggttgccgcgatgatcacgtcaccggcgccgtcgttgtgcagcaatgccaccgcgccggcgatggtgccgccggtgtcgatcatgtcgtcaatcaggacacaggtgcgcccggccacgtcgccgacgacgcggttggacaccacttggttgggtacccgcggatcacgggtcttgtggatgaaggcgaggggaacaccacctaatgcgtcggcccacttctcggcgatgcgtacccggccggagtcaggggagacgaccaccatgttgccgtccgggtagttgtctctgatgtaaccggtcagcaggttctgaccgcgcatatgatcgaccggcccgtcgaagaaaccctggatctggtcggtgtgcaggtcgaccgtcacgatccggtcggcgcccgcggtcttgagcaggtcggcgatcagtcgcgcggagatcggttcgcggccacggtgtttcttgtcttgccgggcatacggatagaacggcatgacggcggtgatccgtttggcgctgccccgtttgagcgcgtcgatcatgatcagctgttccatcagccacctgttcaccggtgccgggcaggattgcaggacgaaggcgtcgcaaccgcgtaccgattcgtggaagcgcacgaagatctcgccgttggcgaactcccgcgcgtcctgagaggtgacgtggacgtcgagctctttggctacctgctcggccagctccggatgggcgcggccggcaaagagcatcaggtttttgcgattatcggtccagtcgtggctcaacgcgctgccctcgccgtttgggatcgaattggattacccatggtacgtagcgcaccgcccggatttgtcgccgggtagccgggatgcgacttcacggtgtctgatcagcgtcgggtggttgtgtgggctgttggcaggccatttctgaggctctttttgaggcctgagccgctgggctgccggggcgtttgcgctgcacccagttctcgatgttgcgttgcggacccgccgacactgccagcgcccccggcgggacatcctcccgcaccactgtgccggccccggtatacgcgccgtcgccgatggttactggggccacgaacatggtgtcggacccggtccgtacgtgcgaaccgacggtggtgcgccgtttggacgtaccgtcgtagttgacgaacacgctggaggcgccgatgttgctgtactcgccgatgtcggcgtcgccgacgtaggtcaggtgcggcaccttggtgccggtgccgatggtggagttcttgacctcgacgaacgcgcccagcttgccgtcggcgcccaacgcggttccgggccgcaggtaggtgaagggcccgaccgcggcgccatccccaatcgacgacgacgaaccgtgggtgcgcaccaccgaggcaccgtcgccgacggcgacgtcggtcagggtggtgtcgggaccgacgacacagcgaccgccgatctgggtgcggcccagcaactgggtacccgggtgaatgacggtgtcgcggccgatggtgacgtcgacgtcgatccaggtggtagccgggtcgacgacggtgacgccggccagctggtgagcggccaccacccgccggttgagttcggaggccagctcggccagctggacgcgattgttgacgccggccaccaacgcgctgtcgtcgacgtggctggcatgtacggtctggccgtcggagcgcaagatggcgatgacgtcggtgaggtagagctcctgttgggcgttgttggagctcagccggctcagtgcggaccgcagcgcggcgatgtcgaaggcgtagacgccggcgttgacttcgcggatttcccgctgcgatggtgtcgcgtcggtttgctccacgatcgccatgacttcgtgatcctgggtgcgcaggatgcggccgtagccgaagggatcatccagcgtcgtggtcagcaccgtcaccgcagccgacaccgcgcggtgggtggcgatcaagtcggccagcgtgtcggcgtccagcagcggggtatctcccgaggtgaccacgacgttgccggcgtagtcatcgggcagcgcggacagcccgcagagtaccgcatgcccggtccctagcggtcgatcctgcagggcgacgtcgatcgttcggcctagggtgtcggcgagttcaccgactagcggcgcgatgcgctggtgatcgtgtcccagcaccacgattagacgctgcggcgccagcttggcgatcgcatgcagtacatgcgacagcatgctgcgaccggcgagtgtgtgcagcaccttgggggtgtccgaacgcatccgggtcccgggcccggccgctaggaccaggaccgcggtgtcaccaggaaacgtcatcaaccctccttgaagctccgtcgccaggactcgaacctgaactatctgaaccaaaatcagaggtgctgccgattacaccacgacggattgcacatcgatgtgactttagacggtgtcaacgccgtcagcacagtcaacgctgtcgccgtctacccaccggccccacgcaaaccgatacccttgttgatgtggccggaccggataaagggccggataaggcgccggaaaacccgacgcgggtgacgcgcgccaggatgacggggaccgagcgccgtcaccagctcatcggcatcgcgcgatcgctgtttgccgaacgcggttacgacgggacgtcgatcgaagagatcgcgcagcgcgccaacgtatccaagccggtcgtctacgaacatttcggtggcaaggagggcctgtacgcggtggtggtcgatcgggagatgtcggcgctgctggacggaatcacctcgtcgctgaccaacaaccgatcccgggtgcgggtggagcgggtcgcgctggcgttgctgacctacgtcgaggaacgcaccgacggcttccgcatcatgattcgcgactcgccggcctcgatcagctcgggcacctattccagcctgctcaacgacgccgtcagccaggtcagctcgattctggctggagacttcgcccggcgcggcctggacccggacctggcaccgctgtatgcgcaagcattggtgggttcggtgtcgatgacggcgcaatggtggctcgatgcgcgcgaaccgaagaaggaagtggtggccgcgcacctggtcaacctggtctggaatggcctgacccacctggaggccgatccgcggctacaggacgagtagcgggcggggaagccgggcccaatgttgactaacctcggcgccctagaatggccgcatcatgaccgcaccggggcctgcctgctcagataccccgatcgcggggctcgtcgaattggcgctgagcgcgccgacattccaacagctcatgcagcgcgccgggggtcgacccgacgaattgacgctcatcgcgccggccagcgcgcggctgttggtcgccagtgcgctggctcggcaggggccattgctggtggtcaccgccaccgggcgggaagccgacgacctggccgccgaactgcgtggtgtgttcggggatgcggtggcgttgttgccgtcctgggagacactgccgcacgaacggctctcacccggtgttgacaccgtcggcactcgcctgatggcgctgcgccggctggcccaccccgacgatgcccagctgggcccaccgctgggggtagtggtgacctcggtgcgctcgctgctgcagcccatgacgccgcagctgggcatgatggagcccctcacgctgaccgttggcgacgaatcccccttcgacggcgtggtggcgcggctggtcgagctggcatatacccgggtggatatggtcggccggcgcggcgagttcgctgtgcgcggcgggattctggacatctttgccccgacggccgaacatccggtgcgggtcgagttctggggcgacgagatcaccgagatgcggatgttctcggtagccgaccagcgctcgattccggagatcgacattcacacactggttgccttcgcctgccgtgaactgctgctgagcgaggacgtgcgggcgcgggccgcccaactggccgcacggcatcccgcggccgagagcaccgtcaccggcagtgcttccgacatgctggcgaagctcgccgagggcatcgcggtcgacggcatggaggcggtgttgccggtgctctggtccgacgggcacgcgttgctgaccgatcagctgcccgacggcacgccggtgttggtgtgcgacccggaaaaggtgcgcacccgcgccgcggatctgatcaggactggccgtgaattcctggaagcctcgtggtcggtcgcggcgctgggaactgcagaaaatcaagcccccgtcgacgtcgaacaactgggtgggtcggggttcgtcgaactggaccaggtgcgggccgcggcggcccgaacgggtcatccgtggtggacgttgagccaattgtccgacgagtcggcgatcgagttggacgttcgggccgcgccgtcggcgcgcgggcaccagcgtgacatcgacgaaatcttcgcgatgctacgtgcccacatcgcgaccggcgggtacgccgcgctggtcgcgccgggcaccggaaccgcacaccgcgtggtggaacggctgtccgagtccgacacccccgcggggatgctcgatcccggccaggcgcccaagccgggagtcgtcggggtgctccagggcccgctgcgtgacggcgtcatcattcccggcgccaacctggtcgtcatcaccgagaccgatttgaccggcagccgggtcagcgccgccgagggcaagcggctggcggccaagcggcgcaacatcgtcgacccgctggcgctgacggccggtgacctggtggtgcacgatcagcacggcatcggccggttcgtggagatggtcgagcgcacggtcgggggcgcccgccgggagtatctggtgctggagtatgcctcggccaagaggggtggcggggcgaaaaatactgacaagctctatgtcccgatggattcgctggaccagctgtcgcggtatgtcggcgggcaggcgccggcgctgagccggctgggcggcagcgactgggccaacaccaagaccaaggcgcgccgcgcggtgcgcgagatcgcgggcgagctggtctcgctgtacgccaaacggcaggccagccccgggcatgcgttctcgccggacacgccgtggcaggccgagctggaggacgcgttcggcttcaccgagaccgtggaccagctcaccgccatcgaagaggtcaaggcggacatggaaaagccgatcccgatggaccgggtgatctgcggcgatgtcggctacggcaagaccgagatcgcggtgcgggcggcgttcaaggcggtccaagacggtaaacaggtcgcggtgctggtgcccaccacgctgctggccgaccagcatctgcagacgttcggcgagcgaatgtccggattcccggtgaccatcaagggtctgtcgcggttcaccgacgccgccgagtcccgcgccgtgatcgacggcctggccgacgggtcggtggacatcgtgatcggcacccatcggctgctgcagaccggggtgcgctggaaggatctgggcctggtggtggtcgacgaggagcagcggttcggcgtcgagcacaaggagcacatcaagtcactgcgcacccatgtcgacgtgctgaccatgagcgccaccccgatcccgcgcacgttggagatgagcctggccgggattcgcgagatgtcgaccatcctgacgccgcccgaggagcgctacccggtgctgacctacgtcggaccgcacgacgacaagcagatcgccgcggcgctgcgccgggagctgctgcgcgacgggcaggcgttctacgtgcacaaccgggtcagctcgatcgacgcggccgccgcccgggtgcgtgagctggtgcccgaggcgcgggtggtggtcgcgcacgggcagatgcccgaggacctgttggagaccaccgtgcaacggttctggaaccgcgagcatgacatcctggtttgcaccaccatcgtggagaccggcctggacatctccaacgccaacactttgatcgtcgagcgcgccgataccttcgggctgtcccagctgcaccagctgcgtggccgggtgggccgcagccgggagcgcggctacgcctatttcctctatccaccgcaggtgccgctgaccgagaccgcttacgaccggttggcgacgatcgcgcagaacaatgagctgggcgcgggcatggccgtggcgttgaaggacctagagatccgcggtgccggcaacgtgctcggcatcgagcagtccggacacgtcgccggcgtcggattcgacctgtacgtgcggttggtcggcgaggccctggagacgtaccgggacgcgtaccgggcggccgccgacggccaaaccgtgaggaccgccgaagaacccaaggatgtgcgaatcgacctgcccgttgacgcgcacctgccaccggactacatcgccagtgatcggctgcggctggagggctaccggcggctggcggccgcctcctctgatcgcgaagtggcggccgttgtggacgagctaaccgatcggtatggggccctgccggagccggcccggcggctggcggcggtggcacggctgcggctgctgtgccgtggctccggcatcaccgacgtgacggcggcgtcggcagcgaccgtgcggctgtccccgttgacgctgccggactccgcccaggtgcggctgaagcgaatgtatcccggagcgcactaccgtgccacgacggccaccgtgcaggttcccattccgcgagccggtggcctcggcgcgccgcgaatccgcgacgtcgagctggttcagatggtggccgatttgataaccgcgctcgctgggaaaccgcgccagcatattggtataacgaaccctagcccgccaggcgaagacggccgtggtcgcaacacgacgattaaggagcgacaaccgtgatgattgtcgtcctggtcgacccccggcgtccgacactggtgcctgttgaagcgatcgagttcctgcgcggcgaggtgcaatacaccgaggaaatgccggtcgcggtgccctggtcgctaccagcggctcgttcggcgcacgccggaaacgacgcgccggtgttgctgtcgtctgaccccaaccatcctgctgtcattactcgactggccgccggtgcccggctgatctcggcaccggattctcagcgtggcgaacgactcgtcgacgccgtcgcgatgatggacaagctgcgcaccgccggaccgtgggaaagtgagcagactcacgactcgctgcgcagatacctgctggaggagacctacgagctgttggacgcggtccgcagcggcagtgttgaccagctgcgcgaagagcttggtgatctcttgctgcaggtcctctttcacgcccggatcgctgaggatgcgtcgcaatcgccgttcaccatcgacgacgtcgccgacacactgatgcgaaagctcggcaatcgggcgccaggagtacttgcgggcgaatcgatttcgctcgaagatcaactggcgcaatgggaggcagccaaggcctcggaaaaggcgcgaaagtcggtagccgacgatgtccatacgggccagccggcattagcgctggcgcagaaggttattcagcgtgcccaaaaggctgggctgcccgctcacctgatccccgatgagatcacttctgtttcggtttcagctgacgtagatgcggaaaacacgctgcgcactgccgttttggactttattgacaggctgcgctgtgccgagcgggcaattgccgtcgcacgccggggcagcaacgttgccgagcagctcgatgtgacgccgctgggtgtgatcaccgagcaggagtggctcgcgcattggccaactgctgtcaacgattcccgcggcgggtccaagaaacgtaaaggcatgcgataaccgccccgagtgcgacggggtagtcaacaaacccatgggacgatgatcgtgacggaagccggtataggtgccctacgagggagagttgtgtcgccgagacgctggttgcgggcggtcgccgtgataggggcgaccgcgatgctgttggcgtcgagctgcacttggcagctgagccttttcatcaccgacggcgtgccgcctccgcccggcgatccggtgccgccggtggatacgcacgccggcggccggcccgcggatcagttgcgcgaatgggcggagaaacgtgctgcggcattgggaattccggtcatcgcgctggaggcctacgcctacgccgctcgcgtcgccgaggtcgagaatcccaagtgtcatcttgcgtggaccacgctggcgggcatcgggcgggtggagagtcaccacggaacctaccggggcgccacgattgcgcccaatggggatgtaagccccccgattcggggcgtccgcctcgacggcaccggcggcaccctgcgcatcgtggacagggacgggggcggcctggacggtgacgccgcggtggagcgtgcgatggggccaatgcagttcatttcggaaacctggcggttgtacggggtcgctgccagaaacgacggcatcgccaacgtcgacaacatcgatgatgctgccctctcggcagcgggctatttatgctggcgtggaaaggatctcgcgacaccgcgagggtggataaccgcgctgagggcctacaacaactccgttatctatgcgcgggcggtccgggactgggcgaccgcgtatgcggcgggtcatccgctgtagcaggatgaaccgctaacccaggctttacgctaacagcggtcggggccagccaacccaagaccgtccgtgcagcagctacgacgcaaggagaacccagtgccgattatcgagcaggttagggcccgagagatcctcgattcccgcggcaacccgacggtggaggtcgaggtggcgcttatcgacgggacattcgcccgggccgcggtgccgtcgggcgcctcgaccggggagcacgaggccgtcgagttgcgcgacggcggcgatcgctacggcggcaaaggcgtgcaaaaagccgtgcaggctgttcttgatgagatcggcccggccgtcatcggactcaacgccgacgaccagcgattggtcgaccaggcgctggtggacctagacggcacccccgacaagtcccggctgggcggcaacgcgatcttgggtgtctcgctcgctgttgccaaggcggcggcggattcggcggagctgccgttgttccgttatgtcggggggccaaacgcgcacattctgccggtaccgatgatgaacatcctcaacggcggcgcacacgccgataccgctgtcgacattcaagagttcatggtggcgccaattggcgcgcccagcttcgtcgaggcgttgcgctggggcgctgaggtgtaccacgcgctcaagtcggtcctgaaaaaggaggggctgtccaccggcctgggcgacgaaggcggcttcgccccggatgtggccggcaccaccgcggcgttggacctgatcagccgggccatcgagtcggcgggcttgcgacccggcgccgacgtggcgctggccctggacgcggcggccaccgagttcttcaccgacggcaccggctacgtcttcgagggcaccacccgtaccgcagaccagatgaccgagttctacgcgggcctgctcggcgcctacccgctggtgtcgatcgaagacccactgtccgaagacgattgggacggctgggccgcgctgacggcctcgatcggtgaccgggtgcaaatcgtcggcgacgacatctttgtcaccaatcccgagcggctcgaggagggcatcgaacggggcgtggcaaatgcgttgctggtcaaggtgaaccagatcgggacgttgaccgagacactcgacgcggtcacgctggctcaccacggcggataccgcacgatgatcagtcaccgcagtggcgagacggaggacaccatgatcgccgacctcgcggtggccatcggcagcgggcagatcaagacgggcgcgcctgctcgcagtgagcgcgtcgcaaaatacaaccagctgctgcggatcgaagaggcgcttggcgacgcggcccgctacgcgggcgacctggcatttcctcggttcgcgtgcgagacgaaataggtacatgcccgaagcgaaacggcccgaatcgaagcgccggtcgccggcatcgcgcccggggaaggccggcgactcggttcggggcggtcgcgccaccaagccttccgcaaaaccctccacgcccgcaccgcacgccagccgcaagaccactcgcacgccgcatgagcacattgtcgaacccatcaaacgggcgatcaccgaatcggtcgagaagcgctccgaacagcggctggggttcaccgcgcggcgcgcagcgatcctcgccgcggttgtatgcgtgctgacgctgaccattgcgaggccggtacgcacctacttcgcgcagcgcgccgagatggaacaactggctgcgaccgaggccatgttgcgccgccagatcgctgacctggaggaacagcaggttaagctcgccgatccggcgtatattgcggctcaggcccgcgaacggctcggctttgtgatgcctggagacatcccgtttcaggtccagcttccgtcgacgccgttggcgccgccgcaaccggggtcagacgcggctactgcgaccaacaacgaaccctggtacaccgcgctgtggcacacgatcgccgacgacccgcacctgccgcctgccgcgccaccggcaccggagcccggacgtccgggcccgctgccgccggcctcgccaaaccccgagcagcccggtggttgatcgtgccgatctggaggtggtcacgcggcaactcggccgtgcaccccggggtgtgctcgcgatcgcctatcgttgccccaacggtgaacccggcgtcgtgaaaactgcgccgagactgcccgacggcacgccgtttccgaccctgtactacctgacgcatccggtgctcacggcggcggccagcaggttggagaccacgggactcatgcgcgagatgaaccggcggctgggccaggatgcggagttggccgccgcctatcgacgggcacacgagtcgtatctgtccgagcgtgacgctctcgagccgctcgggacaacggtctccgcggggggcatgcccgaccgggtcaagtgcctgcatgtgctgatcgcgcattcgctggccaagggcccggggttgaacccattcggtgacgaggcgctggcgttactggccgccgagccacggacggccgcgaccctggtggctgggcagtggcgctaacccgggtcgccgcgatcgactgcggtaccaactcgattcgcttgctgatcgccgacgtgggagccgggttggcgcgcggagagctgcacgatgtgcatcgtgagacccggatagtgcgcctgggccagggagtcgacgccaccggtcggttcgcgccggaggcgattgcgcggacccggaccgccctgaccgactacgccgaactgctgacgtttcaccatgccgagcgggtgcggatggtcgccacgtcggccgcccgcgatgtggtcaatcgcgacgttttctttgcgatgacggccgacgtgttgggcgccgcgctgcccggctcggccgcggaggtgattaccggcgccgaggaggccgagctctccttccgtggagcggtgggcgaattaggcagcgccggtgcgcctttcgtcgtcgtggacctcggtggcggttccaccgagatcgtgctgggcgagcacgaagtggttgccagctactcggcggacatcggatgcgtccggctgaccgaacgctgtttgcactccgacccgccgacgttgcaggaggtgtccacggcccgccggctggttcgcgagcggctcgagcccgcactgcgcaccgtgccgctggagctggcccggacctgggtcgggctggctggaacgatgaccacactgtccgcgctggcgcagtccatgacggcgtatgacgctgcggccattcatctttcgcgggtgcccggtgctgatctgctcgaggtttgccagcggctgatcggcatgactcgcaagcagcgggccgcgctggcgccgatgcacccgggccgggccgacgtgatcggcggtggcgcgatcgtggtcgaagagttggcgcgcgagctgcgcgagcgggccggcatcgaccagctgaccgtcagcgaacacgacatcttggacggcatcgcgttgtcactggccggataagtcacatctgccacacgcgtatctgcgcggggggacactcttctgcccgcctcgtagcgacaaccttggccgatgtcagacccgcatgggaatgttcggccatgaccagacaactgcatggaattgagcttcgatacgtgctcaccctgcacctggccgtccatggaccggcggccattaccgaaatgatctaaggcctgggctggcacggctttggagtccggggcagggcatccaaggtggtgtcggaggcactgcgctgggaaatcggacggggccgagtataccggctcgggcgcggacgctacgggccggggtacatcccgcgctccaccgaataccggattcaccaacgcgtgttggcgttgcgggcatccgccaacgtgtcgctgcgaggcgggcaaagtgtacatccgctcccagcggaaacgcctgtggcagatgtgatttaggcttcgaagcggtagcccatccctgattcggtcagcagatgtttggggtgcgacgggtcatcctccaatttgcgccgcagctgcgccagatacacccgcaggtaatgggtttcagtcgcatatgccggtccccacacttctttgagaagctccccgcggccgaccaacttgccgcggttgcgggccagcatttccagcatgccccactcggtcggcgtgagatgcacttcggcaccgtctttgatgaccttcttgccggccagatcgacggtgaatgaatcggtttcgatcaccggctgctccaactcggcggccgcggtgttacgccgtaccgctgcgcgcagccgagccagaaactcgtccattccaaacggtttcgtcacgtaatcgtcggcgcccgcatcgagggcctggaccttgtccgacgaatcggtacgcgccgacaacacgatcaccggtgccgtcaaccagccacgcagcccgccgagcacgtcgatacccgacatgtccggcaggccgaggtcgaggatcaccacatcgggcggatgctcagcggcggcgcgcagcgcacccgcacccgtcgaggcggtgatgacctggtagccacgcacggtcaggttgatacgcagcgcgcgcaggatctggggttcgtcgtcaatcaccaagacgagggtcatgggcggtcctcgggagccgccagatcgatcaccactgtgagcccgccgcccggggtatcggtagccgaaatcgtgccgcccatagcctcgacgaagccgcgtgccaccgacatccccagaccgacaccggtggtgttgtcgtgatcccccggccgctggaacggggcaaagagttgctcctcggtcccgcgcgggacccctgggccctcgtcgatgacattaatcaggacccgctcacgcacccgtcccgcgttgacccggaccacgcagtcgggcgcatatcgcagcgcgttgtcgatcaggttggctagcacccgctccagcaacccggcgtcggccatcgccacggcgtctcccacgtcgaccttgacccggtcgatgccggatcggtaaaaaccggtggcgcccttgccgatgctgaccaaggcccgttgcaccgcttcctccaggtatgcccggcgcagctgggggcgaatcacgccggcagccaaccgcgacgaatcgagcaggtttgcgaccagggcggtgagttggtcgatggactcctcgatggtggccaacagctcggcggtatcctcgggggagaaagcgacgtcttcggtgcgcaagctggacaccgcaaccttggccgccgccagcggggtgcgcaggtcgtggctgaccgccgacagcagcgaccggcgcagctcatcggccctagcgatggcctcggcctggccggcctcttccgccagctcgcgctgcttcaccagacccgcggcctgtgtcgcgaccgcggtcagcactcggcggtcgcgggcggccaacttgcggcctgccatcagcatccaaaactcgtcgtcgccgacttcgattgcggtgtcggcggagtcgacgtcccgacacgggtttgtcccgacgcacgcgacggtttcgcctgtcgatgcgccctgccggacacgcagcatggtcacggcccgttgggaatacgtttcgcggacccgctgcagcagcgtggcaaggtctgcgccgcgcaacaccgaaccggcaaacagggccagcaactcagcctcctgggatgcgcgccgagcctcacgggttcggctagccgcgccgtccaccaacaccgccaccgcaacggccatcgccaacaacacgaattcggttactgcggcgtccggttcggcgatggtccaggtgtagcggggctcggtcagaaagtagttcagcagcatgcccgacagcaaggccgacaatgcggcgggggcgacgccgcccagcaacgccacgatcagcacgccgatgaagaacaacgcgctctcgccgccgatgcccatgaatcggtcgagccaggccaccgtgatggcgcagatcaccgagggcaccaccagcgcggccagccacgacgcgatatgccgctcgcgcggggagacccgcgaccacccggaggcccggctggccgcgggatgggtgaccatgtgaacgtcgatgccgccgggctcctggacggtgcgggcgccgatcccctcgtcaaacaggcgtgcccatcgcgatcgccgcgatgtgccgacgacgagctgcgtggcgttcatctcgcgggcgaagtccagcagcgcggtgggcacgtcgtcgccgaccacggtgtgcatggtcgcaccgaggcttgtcgccagctcgcggaccctgcccagctgcggcgcggacacccccgccaggccgtcgccacggataacgtgaaccaccatcagctcggcgctggacttcgacgcgatccgcgatgcccgtcgcaccaacgtctccgactccgggccgccggtcacggcgacgacgacgcgttcccgcgcctcccacgtggcggtgatctttttgtctgcgcggtacttctccagggccgcatcaacttggtcggccagccacagcaacgcgatctcgcgcagcgcggtcagattgcccgtgcggaagtagttcgacagcgcggcatcgacccgttcggctgcatagacgttgccgtgagcaagcctgcgccgcaacgcttccggtgtgatgtcgaccagctcgacctgatcggccgcgcggacgatctcgtcggggatcttctccttctgctcgatgccggtgatttgctccacgacatcgtttaggccctccaagtgctggatgttgaccgtcgagatcaccgtgatgccggcgtcgaggatttcctgaacgtcctgccagcgcttggggttcttgctgccaggtgtgttggtgtgggcgagttcgtccaccagcaccacctgaggatgacgtcgcagtactgcctccacatcgagttcgggaaacctggcaccccgatattcgacgtagcgcggcgggatcatctcgatgccctcgagcagtttcgcggtcttgttgcgtccgtgtgtctcgacgaccgcggcgaccacgtcggtgccgcgctccagcctgcggtgcgcctcgccgagcatggcgtaggttttgcccacgccgggggccgcgcccagatagatccgcagctgcccgcgcttggtggtcacatgctcaatcatccaccggtagggcgtaaagatcgcgcaaagatcggcgaagagcaacgtcacggtcgtgttcctggggggcccggcaactaccatcctgctgggctatctgatgcgctgcgatgccggtgcacaagaatcgagaggactcacatggccgacttggtgttggtgctgaccgtgatggcctttgccgggctttgcctgctctacgtccgtggctgtgaacggatcattcgccgcgacgaaatcggggaaacaacagtcgaactcacgcgagcgccggccgaatggcgatgactacggtcgacaacatcgtcgggttggtgatcgcggtggcgctaatggcgttcctattcgcggcgctgctgtttccggagaagttctgatgtccgggacgagttggttgcagttcgcggcgttgatcgcggtgctgttgctcaccgcgccagcgctgggcggctacctggccaagatctacggcgacgaggccaaaaagcccggcgatcgggtgtttgggccgatcgagcgcgtgatctaccaggtatgccgagtcgatcccggcagcgagcaacggtggagcacctatgccctgtccgtgcttgcgttcagtgttatgtccttcctgctgctgtatgggatcgcgcggtttcagggcgtgctgccgttcaatccgacggacaagccggcggtgaccgaccatgtcgccttcaacgccgcggtcagcttcatgaccaataccaactggcagtcctacagcggcgaagccacgatgagccacttcacccagatgaccgggctggccgtgcagaacttcgtctccgcgtccgccggcatgtgcgtgctggcggccctgatcagaggtctggcccgcaaacgggcgagcacgctcggcaacttctgggtagacctcgcccgcaccgtgttgcgcatcatgtttccgctgtcgttcgtggtggcgatcctgttggtcagccagggcgtgatccagaacctgcatggtttcatcgtcgccaacacgctggagggcgccccccagctcattccaggcgggccggtggccagccaggtcgcgatcaagcagctcggcaccaacggcggcgggttcttcaacgtgaactccgcgcatccgttcgaaaactacacgccgataggcaatttcgtcgaaaactgggcgatcctgatcatcccgttcgcgctgtgcttcgccttcggcaagatggtgcacgaccgtcgtcaaggctgggcggtgctggccatcatgggcatcatttggatcggaatgtcagtcgcggcaatgtcattcgaggccaagggcaacccgcggctggatgcgctgggggtgacacagcagacgacggtcgaccagtccggcggcaacctggagggcaaggaggtgcgctttggcgtcggtgcgtctgggttatgggcggcgtcgacgaccggcacctccaacggctcggtcaactcgatgcacgacagctacacaccactgggcggcatggtcccgctggcgcacatgatgctcggcgaagtcagcccgggcggcaccggcgtcggattgaacggcctactggtcatggcgatcctggcggttttcatcgccggcctcatggtaggccggacaccggagtatctcggcaagaagatccaggccaccgagatgaagctggtgacgctctacatcctggcgatgcccatcgccctgctgagtttcgccgccgcgtcggtgctgatctcctccgcgctggcgtcgcggaacaaccctgggccgcatggtctttcggagattctatacgcctacacgtcgggcgcgaacaacaacgggtcggcctttgccggtctgaccgcgtctacctggtcatatgacaccacgatcggagtggcgatgttgatcggtaggttcttcctgatcattccggtgctggcgatcgccggctccctggcacgtaaaggcacgacgccggttaccgccgccaccttcccgacgcacaagccgctctttgttggcctggtcattggggtcgtactgatcgtcggcggcctgacgttcttccccgccctggcgctggggccgatcgtcgagcagttatcgacccagtgatgatcgcacgcatggagacctccgcaaccgccgcggcagcgacgtcggcaccccggctccggctggccaagcgctcgctgttcgatccgatgattgtgcgctcggcgctgccccagagcctgcgcaagctggctccgcgggtacaggcccgtaacccggtcatgttggtcgtgctggtcggtgccgtgatcaccacactggcgttcctgcgcgacctcgcatcctcgacagcccaagagaacgtcttcaacggtctggtcgccgcgttcctctggttcaccgtcctgtttgccaactttgccgaggccatggccgaaggacgcggcaaggctcaggcggcggcgctgcgcaaagtccggtccgaaacgatggccaaccggcgcacggctgcgggcaacatcgaatcggtcccttcgtcgcggctggacctcgacgacgtggtggaggtttcggctggcgaaacgatcccgtcggacggcgagatcatcgaaggcattgcctccgtcgacgagtctgcgatcaccggcgaatcggcaccggtgatccgcgagtcgggcggcgaccgttccgcggtgacgggtggcaccgtggtgctgtcggatcggatcgtcgtgcggatcaccgccaagcagggacaaacattcatcgaccggatgatcgcgctggtggagggcgccgcacggcagcagacaccgaacgagatcgcgctgaacatcctgctggctgggctgacgatcatctttttgctcgcggtggtgacgctgcagccgttcgccatctattccggcgggggacagcgggtggtcgtgctggtggcgttgctggtgtgtctcattccgaccacgatcggtgcgctgctgtccgcgatcggcatcgcggggatggaccggctggtgcaacacaacgtgctcgccacatctgggcgggcggtggaggcggccggcgacgtgaacacgctgctgctggacaagaccggcaccatcaccctcggtaaccggcaggccaccgagttcgtgccgatcaacggtgtgagtgccgaggcggtcgccgacgccgcccagctgtcgagcttggccgacgaaactccggagggccgctcgatcgtcgtgctggcgaaggacgagttcgggctgcgcgcccgcgacgagggcgtgatgtcacacgccaggttcgtgccgttcaccgccgaaacccggatgtccggggtcgatctcgccgaggttagcggcatccgtcggatccgcaagggtgccgcggctgcggtgatgaagtgggttcgcgatcacggtggccaccccaccgaggaggtgggtgccattgtcgacggcatcagctccggcggggggacacccctagtcgttgcggaatggaccgataacagcagcgcgcgggccatcggcgtcgtccatctgaaggacatcgtcaaggtgggcatacgggaacgcttcgacgaaatgcgccgaatgagcatccgcaccgtgatgatcaccggtgacaacccggcgaccgccaaggcgattgcacaggaggccggcgtcgacgatttcttggccgaggccacgcccgaggacaagcttgcgctcatcaagcgcgaacagcagggcggtcggctggtcgccatgacgggtgacgggaccaatgacgcacccgcgctcgcgcaagccgatgtcggggtggcgatgaataccggcacccaggcggcccgggaagccggcaacatggtcgatctcgactccgaccccaccaagctcatcgaggtcgtggagatcggcaagcagctgctgatcacgcggggcgcgctgacgacgttttcgatcgccaacgacgtcgcgaagtacttcgccatcatccctgccatgttcgtcggcctgtatccggtgctcgacaagctgaacgtcatggcgctgcactcaccaaggtcggcgattctgtcggcggtcatcttcaatgcgctggtgatcgtcgccttgatcccattggcgttgcggggcgtgcggtttagggcggaaagcgcgtcggcgatgctgcggcgcaacctgctgatctatgggctgggcggtctcgtcgtcccgtttatcggcattaaactggtcgatctcgtcatcgtcgccctcggggtgtcctgatgcgtcgtcaattactgcccgcgctcaccatgctgttggtgttcaccgtcatcaccggcatcgtctacccgcttgccgtgaccggcgtcgggcaactgttcttcggtgaccaggcgaacggcgcgctgctcgagcgggacgggcaggtcatcggctccgcccacatcggccagcagttcaccgccgcgaagtacttccacccgcgcccctcgtcggcaggcgacggttacgacgctgcggcgagctcgggctccaacctgggaccgacgaacgagaagctgctggcggccgtcgctgaacgggtcaccgcctaccgcaaggaaaacaatctgccggccgatacgctggttccggtcgacgcggttaccggctcgggttccgggctggacccggccatatcggtggtcaatgccaagctgcaggcaccgcgggtggcgcaggcgcgcaatatctcgataaggcaggtcgagcgtctgatcgaggaccacaccgacgcgcgtggtctcggcttcctgggcgagcgcgcggtgaacgtgctcaggctgaacctcgcattggatcgcctctgactctcaggcggtagtggcgatctgctgctcgatcatcgggagccgcacccgaaacaccgtctggccgttgcccgactcggccgtgaccgagccgcgatgcgccttgacgatcgagctgacgatggccaggcccaagccgtggccggacccattggaccgagacttgctggcccgcacgaaccggtcgaagaggtggggcaggatctccgggtcgatgtcggggccgtcgtcggtcaccgacaattcaacacacggcgcgttgggaccagtgcggtggcaggtgatcccgatggtcactgtgacgccgggctgggtatgcacccaggcattggtgagtagattgctgacgagttgatgcaagcgggcatgatccccgttgacccagaccggctcgtcgggcagattcttcacccaacggtgggtgggcgccgcaaccgccgcgtcattcaccgcgttgatgaccaggtcggtcaggtcgaggtcctcggtttctagatcttcgccctcgctgagacgggagagcagcagcagctcgtcgaccagcagcgtcatccgccgcgcctcggattcgatgcgggccagcgcgtattcggtggtgggcggtaggtccgagctatcctgacgtgtcagttcggcatagccctggatcgccgccaggggagtacgcagctcgtggctggcgtcggtgatgaactgccgcatccgcagatcggaatcgacgcgatgcgccagcgcaccatcgacgttgtccaacaagcgattcagcgtgtgcccgacgattccgacctcgttatccgggtcggtatcccccggacggactcgcacgctgatctggtggtcgtcatcggtaagtggcatggtggcgacctcggcggcggtcgcggcgacccggcgcagcgggcgtagcgcatatcccaccacccacaccgtcagtgctgcggtaaccaccagtgcggccccaacaagcgcgacggtggtgactttcttgcgggcgatgatctggttggccaggcttagcgatacgccgacgaacagtcgatcggcgccagcggcgctgctgtcaacctggtaggcgcccaggctgcccaggctttcgacacgcggcgggccgccgtcccacacttgcgcttcgatcgcgcggatgacgtcgggcggagcgggtcgtgctccgtcttcggagaaaacggccgatccgatcaccacgccgtcgtgcagcacggcaatgaggtttccgggcgtctggccggtgaactccagcaccgcttgtgacatcgggaggttgccggtgggcgtggatgtttgcgcactgtcgcggtatctggtgtaagagtggttcaacgcgtgcagggattcgactagctcggcgtcgttcatcgcggtgacatagccgcttaggctcagcacggagacgacaccgacggccaccagcacaacggtaacgaccgccaacacgccgagcagcaattgctggcgtaacgagcggggtcgccagcagggggcttttctggaccgagtgtttcggtccgggatcatgccaggctcattccggcggacgcagcatgtatccaatgccgcggaccgtatggatcattggctcccggtcggagtcgatcttcttcctcagataggagatatacaggtcgacaatgctggtgcggcctgcgaagtcgtagttccaaacccgatccaggatctcggtacggctcagtgctcgtcggggattgcgcatcaggaatcgaagcagttcgaactcggtcgaggagagcgagatcggcgtaccgtcgcgggttacctcccggctggccccgtcgagcgtaaggtctccgacccggagtgcctcatcggcgggcctttccagatggctggagcggcgcagcaacccgcgcaaccgggcgaccagctcctcgaggctgaacggctttgtcatgtagtcgtcggcgcccgaggtcagaccggtgacccggtccatcacggaatcgcgcgcggtgaggaacagcgtgggtgtgtagacgtcggattctcggacccgtcgcaggatttccaacccgtccacatcgggaagcatgatgtcgaggaccagcacatcggggccgaccttgtcgaacttggctatggcctcttgcccgtcgtgggcgacttcgacatcccagccttcgtagtgcagcgccatcttgaccagattggtcagcgctggttcgtcatcgaccaacaacacccggatcggtgatccatccgcgcgatgaatccgtggcagctgccccaggatggcttgccgcggacgttgactgcgcgtgtaccccgacatcgtcgtcatgctcccgtatcctctcaagtcctgtgcaagcgcacatgcagttgtcacgggattcataaatttttcaaatgtcgcttatgtagttacttcggcctgaaaaggtgaccgggcgggatgtcgggcttcggcggtgagaaagcggatctcggtttccgggtatacggagcccccggtggaccggttatgcggggagggcgctgatcgtgaccaggttgtgggcgaacacgccgtgtccgacccaggtccgggtgccttcgagaccgccgatccggccgcggtcccagccgtagccgcgtttgaggtggctgatccggccttcgcatccggtccgccatttgatggtgcggcggaacgcttttcggtgttcttcggcgcgtcgatcctgcgaaggtttgcctttgcgcgggatcagcacattcttgacgcccacctcggtgagctgctggtcgacggcggcttcgccatagccgcggtcggcggtgacggtgcgcggcgtgcgtccggcgcgctttttcacccacgccaccgctggcgccagctgcggcgcatcgggtgggttgccctgctgcacagtgtgatccagcacaatcccgtcatcgttgtcgacgacctgggccttgtgctcaaactcgaccggcttaccgagccgacccttggtgatcggggcgggcatcaccgtcgtgcaggctgacccgtcgactcgccccgtccgaagtgatgcccgcgacccgctggcgggtctgcgccacaatctgacgcgtcgcgttgagcagctcggttaggtcgttgaccgcgcgcaccagcccaccacagcggcgacccgcgaccgcatcacgctcaccgcgggcggccagcgcggcggccttggccttggcccggagcaccgcctgcttggcgttgtccagcagctgctgggcctcctgagcagcggcttgggccagctcggccagctcgccggtgaacctcagtaccgcggcccgcgcttcgtcacgccccagctccgcacgcgagcgcagtttcgctgcgaccgcgtgcgcgcgccgaccggccgcgcgggagcggtcgccaacccgggtgcgcaccgcgccgccagcggcctgaatccgtttgccggttgcggcgatccggcgcattgccttggccaacagacccaagtcggtcggataagacacgttcgcccgcgccaccgtggtatcggcccggatccgattggtgcccagcagcttggcctcggccgccttggccaacaatgcctcgttgagcccgtcgatcgccgccgatccgcaacgcgtggtgagcttcatcaatgtggtcggatgcggcaccgacccgtccagcgcaatgcggcaaaaccgccgtcaggtgatcgaatcagccacctcccggcacagcgactcatagcccagccggtagcggaacttcacaaacatcaactgcagatagacctccatcggcgtcgacggccggcccctgcgcgggtcgaagaacggcacgaacggggcgaagaacgccggatcgtccaacaatgcgtccacccgggccagttcctcgggcagtcggcgcacctcgtcgggcagcagcgactcccacaaccagcactgatcgcctaaagtacgaaacacgatggcctcaatcccttccgcaacaagggcattgaggccatcttcccagttcagcaccatccgaccggggatcaacgcgccgactttagcaggtcgaagtagttagtcgttcagataacaacgtggccacacaccaaccggtgtgcggccacgttgtaattgacggcgcgggccttaagccagctttaggcccagctggagccgacggcgctgtcggtttgtgccatgttgttgccggcagcctgcaccttctgcccgtgggcgttggcctgctcgtagatcacctggaagttacggcccagctgggtaatgaacccctggcaggccgccgaaccggcgccgccccaaaagtcactcgcggtcaacacatcagaaatgatggcctgatgctcggcctccagcgacccggcctgagcgcggatcatggcgccgtgagcgtcgacgtccccgaattgatagttgatggtcatgtgtcctcctgagtcgtcgggccgggtcagctgctgaggatctgctgggaggcctgctcttgctgttcgtagttgttggcgtcgcgaaccagcccgtcacgcaccccgtgcagcatgttcacgatgttgcgaaacgcctgattcatctgggtcatggtgtctagcgaggtcgcctcggccatgccactccagcccgcgcccgagatgttttgcgcggacgcccacatccggcgagcctcgtcctccaccgtctgggcgtgcacctcaaaacggcccgccatgtcccgcatcgcgtgcggatccgtcataaaacgcgaggccatgctgctgtctccttgtctcgaagtcgtcacgttgttgaagttctagcggctgtgatcggcgcggtggtggccgcgtggcggacaggttatgactcaacggttaattgctggcctcaaacgagtgagatgtccccctttgtccgcatcacacgacgacctgtttgggcatgacagtgggcttgaatccgtaccgcggcccggcataggcaccggtgcccttggcggccgaggccattcccggcatcatcccggtaactgggccggcttcttcggcggcgacggtccagccgctgccttcgagcgctgtggcgccggcggttgtcgccggtgcggccgtagaccaggccgccggcactgacagccggccgaccagggtggcctcgcctaaacttgcgccgagccccgctggcgtcaccgagtccgccaaccccgcggcggccgcactggcggcaccctcggcagcctcgatggcgccttcggcgatcgctaccggcgccccactgttcagggcatttgctaggaatatcgcggtggggatggcggcgttgacataccaagcggcggtgttgactgcgctgttgatgatgtttgccacgaacggggtcgcgagcagggcgtcgatgtcggcaatgattccgctcagccccgtcgagtcgagaaccgatgtgactggggaggcgagcccactcaccgcgttgggcaggctactgatcaggtccgctacgctcacctggttgacggcggcggtggcggcagccgagccgaccgcggcggactgggcggccagcccgcccgggttggtggtctgcgacggcgggcttaacggttgcagcatcccggcggctcccgaagcggccgcgtagccgtacatagccagagcgtcctgagcccacatctcggcatagagggcttcggtcgccatgattgccggtgtgttgatccccaggacgttcgtcgcgaccagggccgccagcagcgcccggttggccgcgaccacctccggcggcactgtcatcgcataggccgcctcgtaggcggccgccgacgccatggcctgcgagccggcatgcgcagcggcttcggcggtgtaggtcaaccaagccagatagggctgggctgcggcgaccatcgccatcgaggccggacccatccacgactcggtggtcagccgggtgatcaccgactcatacgacgcggccgtcgtacccaactcggcggccaggccgttccatgcggccccggcggccatcatcggtcctgcacccgcgccggcgtacatgcgtgcggagttgatctcagggggtaaagctccgaaatccatggggtattccgtttccgtggagttatttggctgaatttcgttgttggttgagcgtggccgcccgtacgtctgccgcctagacggttgctggcttgggcatgacgatgggtttgacgccgtagcgcggtgcaccgaagccggcgctgttgcgtgcggccgaggccacccctggcatcccggggatgaacgtccccgcggcggcctgcggcgcggcggcggtccagcccgcgcccggcagtgtgctggtggtggataccagggtcgcctgtccggcccaggcgggcggcaccgacaacatgccgatcgcggatgcgctgcccaggccggccgcaattccggcctcgccgagggcggcttcggccgcgcccaatgcacccaattcgcccaaggcggcttccccaccgagagccgaggcggcctcggccgcctcctctgcaggcaggaggccgccgccggcaaggccgatcagcgtagacgtggcggaggcccagttcccggccccgatgttgaggatgttgccaatgccacccgagagttcgggcgggaacaaccccgtcgtcgcttggatgatggccgacgcttcccctgtgatccccgagagtggcgaggcggcagccgatgagttgagcgactcggtgacgccgtaggtaccggcgctgattcccagagtgttgacaaacatgtcatgcatagcctgagcttcggcgctgacctgctggtagaaggtgccgtacgcagtgaagagcgccgcctgcagcgccgaaacctcatcgagggccgccggagcgatggctgtggtgggcgccgcggcggcagcgttttgggctgccatcgcagcaccgatggtcccgagttgcgcggccgcagccgtcaactcttcaggcactgtcttgaggaatgacatccattgctccttgtgtgtgaaacctgccggccgctagcaccccgggccgaccctgtgtgtttgcgtacggctgcctgtggattggcgtaacgctaaccggccaagcctccacagtcgcgaccgaaaggcatgggacgcccgacgtttacggttttttaacgtttacgtcagcatccttaacaaggtcttggcggctgacatggcggtgtgatctggtgcccgggctagcacacttcggcacacaaatgagacgcgcggcgcgcggattctaggcgaatgacggctctttcgcacctggcgtgtcgcggtagggttggtgcactggatcgggtccaagcgctacattcgccgtcaagcctccacagcccgattggcagaggcagcggacaatccgcgctcacgggtgctggcgtttgctagtgccggtaatcttcgaaagagtcgcttctaactgccaatatgccgggtcgaagccactgtccagcactgtcggcatccagatgggggcgttggcgcgctgatcgatacgccgtctgcgcggctcccggcacaatgagttcgtgcccgattcctggccggtcgtttgcgttgacgactggtctgttgccggcctggagacccaggggcaacacccgcacgattggctcaaacattcttcgcagaagcggacgtggctcttcaagccggcgcgaccggagcgcgatcgtttactcggcgaagacgtggcagaaaagctcgccagcgagttggcgcggctacgcgatgtctccacaacaagaggggaagctcacccgtcgtgcaaatgctgagcgggggtctggtcggtcagcgtgaacccgaggctggccgcgtggtcgaacgatgggcacagcgcctccacatactttgtctccagcggcggcacatggaccgcccagttgcggtcgtgacgatcaccgtgggcgatcaatgcgtcgaacgcgaggtaggtcgaaagcgcggaacgtgggtaggagcgcttggtcggcaggtgctgcgaaccgagcaagcgcctgctggatcgcctcgacgttgtgcccacgttgcccgggatcgtcccggtcgcagttgagcacaacctcgggcatcaatgcttgcggcaaccgcacgtccttgaccagcgcaccgcgcacgccgtcacggacagccagctggaccggtgccgcaggtatcccgactagggcgtgtctcccaatttcggagttcccactcgggcgtggatgacggcgcaggccagcaggacgccgccgaggtaggtcagggcgtatttgtcgtagcgggttgcgatgccgcgccactgcttgagtcgatggaagccgcgttcgacggtgttgcgtagcccgtagagcgcggcgtcgaatgctggtggccgcccgccggcagaccccttggccttgcgccggtcgatctgatcttggcgttcggggatggtgtgcttgatcttcttagaccgtaatgcggcacgggtacttgggtgtgagtaggccttgtcggcgagtaagcggaaatccgtgctgcccagggcgtattcggtgctggcatggcgatagtcgtcgagcaggggcagcagttgcgggttgtcgccggcctggcctgcggtcaaccggatccgcaccggggcttcgcgctgatcggtcagggcatggatcttggtggtcagcccgccgcgcgagcggccgatcgcatgatcgtcgggttcatcggcggatttcttgtaatccgacagtgccccctgtggcgagcgtgtccgagcaggcgcccgccgaatgctggtgtgcccgcacgttcgtggaatccaccgacagcagcttctcgatatcctcggccacctcagcgtccaccccgaacaccgcggcaacgtgggcgaacacctcgtcgcaggtaccatccagcgaccaacggtgatggcgcttccacaccgtttgccacggcccgaactcagcgggcaggtcccgccacggacttcccgtacggaaccgccacgcgatcccttccaggataagccggtgatcgctaaaccgtctgccgggcttgccctcatgcgacggcatcaacggctcgaccacggcccagaactcgtccgaaatcacacccactcgcgtcaccggccaatcctcgctggccagtacctaaaaatttgggagacacgccctaggcgcgggctgcagcggtagtactttggcctgttcggcgcatctcctatggctgcggcccgctggctcaaaccttgccttgccacgccaagccattcctagccttgcctagccacaccatgccctgcctagacacagcgagcctacgccgcgtcgagttcggcgaaaatcaaactgacccactaccaccggattgaagggtttggtgcgtgttgatacgtcccgggttgtgcctatgggagggtgtccatctccacgatgccgccgaagtcgagttcgtcgagtgctcggatcacttcgctcgacgggatgccgcgatagaagggtgccgcgttcggtccggtgcccgtcgacggtgcttccgcagagtcctcgaccacgaggccgatcacacggccgtcttgcgcaacgatcggaccgccgctgttgcccggccgcgcgattgccgagtagaggaaaatcttctgccggccggggatagtcgtcgcggccgggttgaccacctcgccacgctgcaccgtgatcgccatctccgcagtcatcggcacccgcgggtaaccgaacacgtagacctcatccgcccagtcgggatcacggaacgccatgccgccaagccgcgggatgtacttgccttcgggcatctcgaatttgattactgcgacgtcgagcgtggggtgcgggtgagcggtgcccgagaagttcaccaactcggcttcggcgtggttgcttgacggatagacggacagacctgcgctcgtgcccgcgagcccggtcacgacatgtttgttggtgatgacgtgattgtggtcgacgacgaggccggttccccaactatccaccggattgccagcgtcgtcgtgaccggcgagttgaacggtcaccgcgttgtagctcgggatgatgagctcggcaccgaacacctcggacaaccagaggttgccgccacgctgtcccttcgatatcgccccctgcgagatgtacttctgccccatgactggcaatcgcgggtcccaaccgagcggcagcagaagtcccgcgcgttccatcgagctgaggatgcggtggagggtcaccgcgtcgcccgcggcgggcaggccgagggtgctcaggtatcgggagaaatctgcgaccgaccacggttcgaagggcaccgtcgtcggcagaccgatatccgagtcaaccggtggtggttcgggtttgccgatcgccgccgcaaccaccgggttgtggaccagcccgaagaattgatgggcgcacatcgccacgttcacacgccacgcaggagtcccgggcttcaggtcggccgccgtgagctgtcgcggtcaggtgctttccgcgccatccgccgtcacctctgccatggtccatctacggtatctgcgacaagggcagcgtcgatgcctcgacatgcagagtcggtgttcgcttcacgcgaactaggcgcgcctagcctggacgagtccccgggccgacattcgcccgaggccttggcctccatcacctaattgtgtgcaaaaccgtatctaattgatacgattgcgcacatggctatctgggatcgcctcgtcgaggttgccgccgagcaacatggctacgtcacgactcgcgatgcgcgagacatcggcgtcgaccctgtgcagctccgcctcctagcggggcgcggacgtcttgagcgtgtcggccgaggtgtgtaccgggtgcccgtgctgccgcgtggtgagcacgacgatctcgcagccgcagtgtcgtggactttggggcgtggcgttatctcgcatgagtcggccttggcgcttcatgccctcgctgacgtgaacccgtcgcgcatccatctcaccgtcccgcgcaacaaccatccgcgtgcggccgggggcgagctgtaccgagttcaccgccgcgacctccaggcagcccacgtcacttcggtcgacggaatacccgtcacgacggttgcgcgcaccatcaaagactgcgtgaagacgggcacggatccttatcagcttcgggccgcgatcgagcgagccgaagccgagggcacgcttcgtcgtgggtcagcagctgagctacgcgctgcgctcgatgagaccactgccggattacgcgctcggccgaagcgagcatcggcgtgaccaagccctattcgtcgccgccaacgaacctgcgctcactacgagatcggctcacccaagtagcggaacggcaaggtgtcgtgttcggtcgactgcagcggcatgtcgcgatgattgttgtcgcacagttcgcggccacgctcaccgacgacaccggcgctccgctgctgttggtcaaaggcggatcgtcgctggaactgcgccggggaattcccgattcgcggacctccaaagacttcgacacggtcgcacgtcgcgatatcgaattaatccatgaacagctcgctgacgcgggcgagacggggtgggaaggattcactgcaatcttcaccgcccccgaagaaatcgatgttcctggtatgccggtcaagccgcgccgattcaccgccaagctgagctaccgaggccgggctttcgcaactgttccgatcgaggtctcctccgtcgaagccggcaatgccgaccaattcgacaccctcacctcagacgcgctcggcctcgtgggcgtacccgcagcagtcgccgtaccctgcatgaccattccctggcaaatcgcgcagaagctgcacgcagtaactgccgtgctcgaagaaccgaaggtcaacgaccgcgctcacgacctggtggacttgcagcttcttgaaggactgttgctcgatgccgacctcatgccgacgcgcagcgcgtgcatcgcgatattcgaagcgcgcgcccagcatccttggccaccgagagtcgccacgctgccgcactggccgctgatctatgcaggtgcgctggaggggcttgaccaccttgaactcgccaggacggtcgacgcggcggcccaggcagtgcagcgattcgttgcgcggattgatcgggcgacgaaaagatgagtgctggcgcggcctgcggcgcacgggagaacacagggaccaccccggttccatagtcaacgtcagcggtgcgggtgtcgatcagacgacgaatggaatcgccctcgcattcctcgcgatcgagtgcctatgagccgcgctcctgcggcctaggcgagcgcttccggggctctcagacatcggcctcgtggcggtgtgcgcggcggcatgtggctctgtgatctcttgcgcgagcgccgattgcgaatttcgtccggcgaaaagtgaccgctccgtgaccttaatgcaagaggtgtgtggtgtggagaggggcgggaggaagggagtgaggcgacggtgtcgagatgcagcgaggattggtggacttccggtagttgtttaacaaggccccggagaccagggggcgagggagagcgcgggccgacttgggtgggtgagcctggcttgggctggtgcgtgagcggaggatcgctggtggccccgtagttggcgttggcctgcggacgtgccgcgcctgcgagggattcgtcaatcttcctgttgatgtcgcccgtgccacgtcggtgagatgtcgaagggatgtgacctggtgcgttcgcgaacagctgctgaccacggccaccgacggcgctcaactgtcgtcgattccatcccacccgtgcttggactttcaaactgtccggcgccgatggggaaacctggtgtttggccggaacgtggcgccgagcctcgataatatcagcagttacgtccaggggtgtggtgtacgggcaggtaaggccggtgggcgtgtcgtagcccagtagtgggcggtcatcgcgtgatccttcgaaacgaccagcaaaagtcaatcgaaggaaatgacgcaatgacctcttctcatcttatcgacgccgagcagcttctggctgaccaactcgcacaggcgagcccggatctgctgcgcgggctgctctcgacgttcatcgccgccttgatgggggctgaagccgacgccctgtgcggggcgggctaccgcgaacgcagcgatgagcggtccaatcagcgcaacggctaccgccaccgtgatttcgacacccgtgccgcaaccatcgacgtcgcgatccccaagctgcgccagggcagctatttcccggactggctgctgcagcgccgcaagcgagctgaacgcgcactgaccagcgtggtggcgacctgctacctgctgggagtatccactcgccggatggagcgcctggtcgaaacacttggtgtgacaa

SEQ ID NO: 650 - DNA, 30042 bp, Mycobacterium leprae
gatcctgagccgctagacacggccgctccatgaggtgcagtcatagctgaaattaggtgccgaggagataacaatacgtcgttaattgggagggcgttgaagtatatggtcaataccgcatggtgacgatgcgctcgggcgcgttggtcgaattggtctgggatcccaccagatccaaacagtctttcggagtatgttggtccgtcgggctatcgcgcagtcgttgaagccgttggcgacgggtagcggaacggcttcgaattattgtgccgatcgcatctgtgtgttccttgcaccgaccataatgaacccaaggtgggagggctgtctacgggttcgtcggtgagcggaccggtaccattggcaggctcgcgggcgtgatggaatggcagacatgccggctttaggtgccggtgcttgaaagagcgtgagggttcgactccctccgcccgcactcttcagctgaacaggccgcggtgttgttccacgtagagctgcactgtctgtgcgggatggccggtggtgtcttcaacatcgtaggttgagcggcgatagcggtcttcgcggtgcagtttggccgtggtggcgatgtgttgtcgcacatgctggggccggctaatttatagcttatcaagaagcgctagccgctcgttgtcggacggctaaacggtgctgatgggtcggcccagggcttgtgtgtgttgctttgccagctcatcgatgtccagcgtcgtcagccagtcaattcatagaccacgcccagatgattcgtggggtgtgcaccgcggtgacgatgtcgctggatgcgacgggcgaggtgcggttggctccgaacggtaggggcagttggtcgctttcccggactgagcgcgcggccactagggcgaagaacgggttcttgagcaagatagtcggcctgatgtgtatgtgtggggaattttagcagctgacgaggtgttaagcgaagacgattcctcgaatccgtccagaactttggtcgtggtgtccctgatgagaccgtagtcttcgatgtaagtcggcggtgcgcacaaccgcgtcctgggcaaggatttgctggaactcctcgccagagattgattctgaggacttctgcggtggttattggctaacgctcctcgctgatgtcggcccggctcgaatcttcggctctaccgaaaccttacctggtatttgtcgagcgccctgaaaagcaatagtggttagggatgtgggatacaggtggcgttgctaagtgattggatcacggtggtcacaggcggtgcacaagatctgggtctggccattgtcgagtggcgcgttgtggagggcgcgggtggtgctcggtgggaggaccttgagacaacctggagttgcgacgaaacaattgggtggtgcagatgttgccttagcggtgttgtgcaagtagcaagtaattcgtgcagccgacgtcgacgtcctatcctcgtgcggacggccgtcgaatagtttcggtggaggtggacatcatggctaacgccgtcgggatcacccgcgttacggtggtgcgcaagatgactgaagagcaagtcgacgcggtcattgttggtgcatctgacgggggacttgaaacggtgccaggatggtggcagcgatcatgcgggggtaacaacgtggcgtaattgtgaccatcttgtaggtgtctggcatggccggtcagaccaattattcggcggttaaggctgggaatggtgatgaccaaggctggggttaaagagcttgcttaagctaggtgttcgggtgaacgcgatcgctcctgggatgatccgctcggtcatgaccgaagcaatgccgcaatgtatttgggccgctaaagtggcggaggttacagtgaggtgagctggggagcctagcaaagtggccaatgccgctctagtgtttttattttcgatctgtcattgcatatgcccggaactgttatgggaagtcactggcgttctacacatctgaaaccaggagagtggctatgcgccaagttgttatttattgaaacctagcaagtatttgcggtgatgcgacagtggagtttcgttgccgtcgaacgggaacgaactaatatgcacggttaggaaatctcactaggtcaccccgtgggtgttaccggtggcagggtgttaatcaccttgatgcgctaactcgattgtcgtcaggaatgttatgggttggaggctatgtgcaatcggcagcgtcgcgatcttcgaatggtttgcgtcaacatgaatggccctgggttgccgctgatcggtgtcagcgttgttagggtgtcaatttttgtcttcgcacctttgtgtgctgcaatgttcagccagcttggcgcggtgatccgtgtgaatctgatcagcgatgcctccgacgtacatcgctggccgatggcgacagacggtacgtcgatttactgtcctgatcaagagaaagcgttcggacacgatcgatctgctttcgaccgaagggtaacagctcgtccagctgctggtcgtcgagggggacgacatcgtcgtcaccaacgtcgttagcttggccagggtaggccatgattgcttggctgccaagcgttccgatgtcgttgatgtttcaccttgcttgggtgcgtctgcggtgccaccggtgtggattacaccgtgaacgcgaatgtcggattcccgctcgtcaccggcccggccaatcatgactgggcctatccagccatgtgttaccggtctgggatgtgtgttgtggcatctacgctgtgctggccgtcgtggtcgctgtccgctgccgtgaccaatctggggtaggtgtacacatcagtctggcactggaggatgtcgcgctggccactgctagacacttcgggttattgacactgagtacgcaacgcccacgtttcgacaacgccatctacggccattacggtcatgattgcatatgattgtattcagtcgtgatgggacagcgttcataattgccgggttgaccgggaggagctttcgcgacttggtttaggtaatcggaataggggtagcagtggctgcgcttgccacggtgctccgtgttgactttgacgaccaaggcgtccggagtatcggtatcttgaagtgttctccggcttgcttgcgacctagtcgagccaattacacagacgaagatatcacacaccgtgttgttggaaccactgttctgtttgagcgataccgcacgttcgcagaggttgccgatgacgagcgggtaatttgcaatctgttgttccccggttacacagcctggtgtcggagagtgtttcgccctcgggatgtcggtcgcgttcgacggtactcatcccgctagcacgctcgccccggatagatgtcctcaccaactgtttgagcttgaccaacgccgacatcacgcgctttttaagtgctagaacgatcgttggctgggttgcggtaaggaaattcgtcgacaaggacaaggaagtcattctcaacgcgccgtaacgaaatgcggtgacgcctatgcgcaggacatcatcgatcggatacgggatatgggtcctgttcggattgatgattacgcagacttacggcgtcctgggggagtcgttattgacctactcgtttacgcgttgggcgttgaggagctggcgcgcggcaggatgagtgtctctaaggtgcttaaactcacttaattgtggcttacctgttgtgccagcacggcacccgaggctcagaagcagcttttcctgcagcgtgcatcacggaccggcgagtacagaggtgcgttttcaatgtcagagccggagtcgggttctgatcttgccgcgatccgaatccgcatggggcgtaacctggacggcaccctacaccattcaacggccagaagatgtggccgactaacggcgctaatttcacgttggttgccgtattggtgtgcaccgacgaaggccgccgagaagctgcaccgcaacctcgctgcgtttctcgtagaaaagccaaacgttttcggtgaagtggtgtctgggctaactatctccggcaagatcgacaagctgagcttataagggcatcgacaccacggaactcatcttcgatggctacctagcaagcgttgatgacatccgtggcggccccactccggggcggggcttcttccagatgatggccagtatcgaagtcagccgcgtgaacgtgtcggcaagaacttgtggcgtcggcattcgtgccttcgcgctcgcggtgcacgacttgtaattaatagtagtttagtagcgtcacaccttcggtaagccaatcgcagagcaccagaccatcgtgttactgctcaccgaaatggtgatcaaagtcaaagccatgcatctgatgctggtcaacgtggtacagttgaaagattcgggttgagcaacgacttagcttccggtatggctaaataccttgctaacgaattctgttccgcagtctacctagcagagcgtccggattcacggcggttactcttacttcaaggactacgagaccgagtggttgatgcgctcgacgctccgttcttgctcatcggtgaaggaagcagcgaaatccagaagtccatcatcagcaagcggattatcggagtgaattgtgtgtgaccggtgcctgttcttgactcaggtgcgcgacctcaactgtccgaggacgttgcgcgctttgtccgcaagaggatcttcgatggtacttacgtagcaggacagtagaccaatggaccacggattaggggataaacgtcacactggttgtgaagcgctgtttattctaagtgcgcaaggtttgcttgcccagcaacggcgccgcggctaacatcaccgacagccaactgctggaactcaaaaatatccaggaccagctggaagatgcttatgtcgaaaccggcgacgagcgaacggttcctctcaattttcatcggggcatcaatgttgcgatggactcgctaaaatttgctcagctgatgtcgcagattacccgctacgcgcctgaattcggtgttccccatgatcggggactgtcctgaccagtctgaactggtaccatcacccggttttgtctgcgctaaagaaacacgacggcaagatcgcccgggctacaatgtcggaaaccttgccgccgctgctattccgtccattgaccaccttgttgcgcgtggtgtgcttgctgaagtgagctgttcgtcatctcggcagcgtcggcgcaatacggttgagttgaggtttttacggaattcgctaagaattgctacatgctgggggtttctatagcgacgctgcaggccatttagtatccgttagcggatatagcaatcaccgtccaaagcggctgtaatttggcccggcgcgcagcttggttcttggataacgaacccgacgaataaccagagtttggccgttgtcggtgttcgcgttcatggctgaggaggtcgttagggcggcgacgatgtcgcggttaatatccaaggcagcttgggagttttggcgtaagccgccgccacggcctacctgacctagtgtacgccgggggtagccgttggcgggcagtgatccaggtttcagcgcccagcagactgccgagattgtggctgcccgtgagagcgcgttacttaaccgtactggtttccgttacttaaccgtactggtttcaaggaaggagcttcgctatggatttctttcggattcagctgtccgactaagaccgcctttcacgacgaagcgtggaagtgtatcgtcgcacacatgaccgaagaagtcaggcgtcgagaccgctagacggaagacaactttaattaaaggtctgaatctgacgttcggcactgcgggggtatcttggctgcggggtggaagccagcatcgtacggcggattcagcgggatgcggcggcgttagatatagtgcgcgggcacacatgtcgtgggtggcctgggaactaccgctatggtggcgctgtttggtggtgaagtagttccgttcggtttcggttgagcttcatgccgaggtgttacctggggtgtcggcggccaagtacggatgtgcctctgctatactgagcccgaaggcggttcggatgttgccatttgcaaaacctgagcagtacgtgatgttggtagctggctgattaactggtcgaagatgttggctaccatactgttgcgcacaactgctactgatgctctcatcagcgttcttggtcaccaacacctcatccggatgaaatatgacactagagcttgatcatgtttctggtgccgcagcactacttgccggccatcaaaatccagggcatccgtgccagggcatccgtgctatcgacggtgaccggaccaacatcgtctactacagcgacatctgcgccgacgacagatatcgcctcggccaggcgtaagtgggctggacggtggtatgtgagccaacaccaagcctggcgtcctgcaagtcgtggccgcacccgacggcttgcaggacacctcaatcatgaggcatcaggtcaagttggtagccgcagtggtcgacaacgccacttaagcacctgtgccgattcgctactcaactagtttgagcgagcggctcttaggtagttttacgttaggaccaagcggaactgacagagcggtcagtgtcagccatggaggagctggcgcgttgcaccttttggccgtgagagttggcctgctcgtaaatcatctggaagttacgacccaggtcggctatgaacatttcatgggcagtcgaaccttgtccgccccaaaactcagcggcgtcccgcacagtggctagaatggcctggtgggtggtctccaacgcagccgcttgagcgcggatagccgctccatgtgcgtcgatctccccaaactggtagttaatgtttcccattactttgtctcctcctgcactgaaagtattgattagcagcgattttcgcaactagctgccagaaaggattttcctcgagttctcttcttggtgctcgtagcgatcggcggcggtacccagctggtcacgcacgtcctgcagcagggtcactatgtggcgaaacgcctgatttatctgccccatggtgtcgtgggaggtcaactgggcggtcccactccagcccgcaccagcgatgtccatcgaggacatgaacatcttgtgggactcgtctcgcacgttctgggcgtgcatgtcaaatttgcgcgccatgtcccgcatcgcctgtgggtcggtcataaaatgtgcagctgtcatcctttataatttccttccattgatttcgttgcgttgtggatgaaacgtcaacctcgcagcttttatcccgctgcggggttgcggggcatcacgaaagctcttggttgcaggcgtagtgcagtgttgacgccgccagtaccgctgcctccgccagggaccataggtgccatcggtagcccgccccccagcagcggcgccgattcgctttcggttgcgacggccaccctggctggcgacaatgcgcgcgtcgctgccgtaaccggctggctggccgtggtccaagtttgcggcacccgcaacgagccgatcgacgcggcccgacccaattgagcagtcacgtgaccacccgagcttgaacccagcaatccgcggcctgtcgactgtacagcacttcccatcgccttaaacgcgctttctgctgccttggtcgtcgtcggcgccaagctcttcatcgccgaacccatgccgttgaccaatgacaaacccgcattggccatgcccgcatggttgttgatcatcgataaggtgtcgtttatgggcgacaagtgttgtgcaaagcccccccacaactgtggtgcggcagccgacgaagagtcaggaacagctgtttgtggggtggcgacgtctacatttacttgctggtccacttgcggtacgacagtagcttccatcccctcattgaccgcctgatcgagtgcggcttggctgattgcctgctcggcctcaacaacctcctcaacaacctcctcaacaacctcctcaacaacctcctcaacaacctcctgggctaacccgacctcattgacccccagcggcggcgccgtaaatgctttcgtcgcccccactgcctccagcacactagcttgatagctggtcattgctgccgcgtcttggatccacatctcggtgtattcggcctccttctccgcgatcgcggtggagttttgcccgaaaatgttgctcataatcagcaggcatgcttgcgcgcggttcacgaacaccatcaggggcggcaccgtcattgtaaaagctgtttcgtaggcgttcgctgctaccgtgagctgggttgcggtcagctcggcgcttgcggcgttctgggtaagccacttctcatacggcgtgacccgctctgccagcgccgctgctgactcaccttcaaatgttgttagtaatgcttcgaccgctgactgcaacccctgcgctgcagcagtcagctccttagccagaacaacccatgctgcggcagcggtcaatatcgggctggagcccgggccgagatacatccgggtggagttggtctcgggcgacagcgctgcgaaatcgaacatctcgtcgctcccttattactcgttggtagccactcgtgtgcagctagcgacgtccgctataaactatcgtgattggcagtctcggtacccgcatatgctgacgagctcgtcaacaagctctggattagatcctgatgattggtcgcgccctgagaggcgtgcgcctggtactgtctcccatggccactgaaaaaatgtgctagcaagattgacacatcatcggcagctgggggagcaatttcagtggtcagctgggccgccgcggcgttgcttgccactgtggcagcactgaggccctccaaggtgttagctgccgcggtcagggcctgtggctctgcattcaagaaaaggggcatgcggttcctcctcgaaactcaaacaatccgactactgcacggggaaagctcaagcgacctgctcacctgcgcctcccttccgactgcttggtggtacgaactggccttaatgatctccgttatgcaacgtttacaacaggttaagagtttataacaggttaaaaccacccgagttgccgcagtttaaggtgcaaagtgcacccatcgacccggcaaaaggttaattccgtctaaacaaataaacactaggtaaacagcactcgaaagatttgtaaaattgggcaacagtatgcatgctccgtcaccggtgtaattgccaggtatgcttccccgcccggagcgatgggtacaccacccgcagcggatcctagttatgcgatatatgacgcctaaaacgattatcgttaccggtgtcagtggcggcatcgggctgcgacgactcgtcggttacgtcggcgaggcgaaacactacttgttgtagtggtggtggaccggtaggtaagcaggaccgccgtcgtggccacggagttgggcacggactatacttaggtgttgccttctccgagctgtgctggccacatgaactttccttcgtaaggtcaccatcactgacttgaaaagtgcggatcggagtcggcctaacactggcctatgtgctcgtgaagctggaatttatcttgttcaccagggaattgcatcggcgttaccgttttgacggggctctcggttgcttaaactcatattgtgcagcacaggccggtggagcgatttgtcgtggccgtagaccagaactcctaaccagttggtctagttggttaccaccacgcccggtgtggattgggttcctggcgaaatactataatcgaagtacaagtatcgcggaaatcaatcgcgcagcctacgacctaggttttgcgtgtctattttgagatcgcacactggcccagatcacctaacaactccagcgagtgatcacccgtcagaaatcgcatacgctgaccccaaaatcgataattctccttatgattgcacggtttcgcaggtcattgtaggcgttgttgatgttgtataaacgttagtgcttcgtgatcatctcgtctagctgtacttggcctgtctagggtagatcctggccagtcggaagatgtcctcctgtgggttgtgtgaactaaagacgttgcctgcgagcattttgttcatcggggtcaagtcctgaagatcaatcttgattggccaagtcagttgcgaggccatgccggtgagtacggagaccccgctcttgcagggtagcattagcgcgtagtggacgttgtcgctgacgatcaacaaaggcgagatgacaacggcgtcagccattattccatatgtcagatggcgtaacagatttagtgcgtcgaccactattgcagctttgtgggtagcgctgagctgccgtgctaatttttgcttgaattcgcctcgatcaacagagaccatctttgcggcgcctccgatccgggtgctctggatcgcactggtttggattcctccggtaccgcctgagtgcattccgggacagtttgcaattgaatcgtagccggctgtaatggcgcacgacagtaacgcgcttggtgccagtggccagtggtaagtggtggttctgtcttcacgagtgaatccctagataccacagtggtgttttgtgaagggtttccgacattggcacagatggccgaggatcaatcatcggcagtgtgatggcggaatgtgccgtcggtaggcatgtccggcgttaagacggtggccccgatgtcacagatgtactccattgtgttcgcacaccagcgggactggcagcacactgcgcccagcgatatcgtcaaggcatcgtgccagccgatcgtcgggaacatgagtgggcagctcgagggatcgaagcgctttattggatgcggacagatcctctttgaggatgtggtcatcggagtggcacaaccaggaagcaactatctcgaccgggacttcgccggtccacggcgggtctagttcacattcctcaccagaccacggtccgccgacgtcatgcaggatagccgcccgactcctcatgctgcctttctatacggacgtgaaagtgaccaggaagtctattgggctatcaggtaaggtcaacccgacaattctggactttttatcctttccatggttgccaacaagggcctagatttagtgatgcgatcgaacaagttgttcaacatcacccgtgtgtccagctgtgctaggcctatccctaggcacatgtggctcccagccaaggtggtatgagcttgccgtggccagtggatgtcgaaggtgttgggctcggtccaccggcttccatcgcggttggccgagcccatgagtatgtcgactcctgcgttgggaaggatggtcttgccgcctattgcgagttaggcaattgtaatccgggtgactgaggcccagttgggggtttcggaccgcgagccttcttcgatcgcgcttggaatcagggaccggtcctaataaccatcgccagctgctcggggtggatgtagataatccggcctgaactggcccactgctacgtcaacgagcgtggtgatcaagccgcctcggagcgcgccagaagtgttgaccatctgcgggctaatcggcgtcgtcgtcgcgaacttgccttcgcggtgctcggccgctcgctgatctgggtgaacagctcgccgagcaagggcggggattgctcgtcgctgtttcgaatgccgagagtgccgctaaaggaattatacagttggccgcgtctatcgtgtgctggttccattcggttctcagccaatgtaaccggagtgccctcaccaccgtctgcatggatatcccggccgcggcaccgatatccatgcccgggcccaagacccgtcggtgatgccttgttccacgatgtcgcggatcaattggtagagcggagggaggcacgtgcgcgtattcgcggggacgggtctcgtccagatgcaggttattagagactcaactacagattttagcgtgttgtcctgagtgcttgattctggctgtgtgctgatgctgtcgatcatcagttcagcgtggcggtgctgtttagtctgcgggtcgcagcgtgctgcaagtgtgccgattgcgcgataatcctgtctaacagtgctagcagcaattcgtttttgctactgaaatgctggtaaaatgtgcacagcgcgtcttggagcgtgggaagacttcttgcacggtgaagtcggcgtgttccgattttgctcagtatttctactgctatcttgattttacaaagtggtcggcgcgcgctatctttcgacgtcatccgctctggtcgtgggcctctcactcaactctaagaccgacgttcatctctgggaatgcggttacagtattttgttgcggccggtagtgcgaatcctcgcctcggtagttggccccgctttgctcgatttgtgttgtggcttaacgattttgagtattgtttgctttttcttggtgcggcggcaatgcggtgcgcccgcatggtgatgcgccagcccggacaaatgagctggtgccgacaagaacctacggaactgtacatttggcattgcggaaaatctacgaaaccgtatttgcaagcaacagtcgacaactgtaatattctcccagccttatagtgtggatcacgtatacaattttgtcagggaagcttgaatgacgaaggtttggacggtagccgagatggagatgatacgtaagaggtatcgatggtgacagtgcgaggggtgaacaaaggattggcgttgaacagttcgtcagtgccaactttggttgatgctcatgttgttgcggtgcctgctattacgcgcagagcggcgagtggcggttgatgccgagctttttcccgcaagtgactacgaacgtaaagtccattcgacagttgaggtttatttttctttggctagtggagacaggcgatggggctgacgactcctgctgatgttcataatgttgcgttctcttaagccacgcatcggcaaacgtggttacagcgaagaatgaggtcgatctctttcttgacctcattgaggaagaggtggtcagccatatcgagaggaatgctgagctccgtaatcgtgttgctgggctagacaagcggaacaccaggctcgctgacggacaagtcgagcttgcacagcggtgcactgctgtcactcagcgggaacggcaagttggtgaacaagaggcccggctgtgcccgcaagaagccgcgatcgcccggcgggaggtccggctgcgtcagcaagaaaccgagtttgcccaacggcacgctgttgtgagtgaaggtgaatggcaagttagccaacaagaggcttggctctacgagagcaagaaactgagattcgtgagcggcaggaccgatcagagtcgatccgtccttttgcgtcaacggtgatgcagctatttaccatatgacgcagtcctctcactctgtgcctcaatgcattgcgccacatctgcagcacgtcgttacccatggtttgcttcgctcctagagtgggcggacagtaagcgcggtgcatggtcggcaccgcatggagcggacagccgattcgggcggtgaccgacatactcggtaacaggatggctgagacggtgtgtgagtgtatgcgcacgagtacggttcaacccacgccagtgcgtaattgcctaatgaggtggtctctccattgcaggatctcatgcgcgagaacgccgaatttaaccgatccaacggcattctcaaagctgtggcggctctccttgctgctgagcttgaccggcactaagtgtgttgtggcctgcggtgcgatgatcagcttcttcgggctgctgtcaccgttgagcggttcaccttatgttgtcactgtgtgtggaatctggtcgatgaattccagcgttttcggaactttgtatctgtcaagcttgctctttgcttagtcgatcacctgctgctctgtcgacggcacagccttgtggttagcggagtagtttgcaccaccgcgtgcgcaccttgcatccccagcgcgagtcggccatttcgacgaccaccacgtccggcagatgcctgagtgtgtggcaagggcagactcgacttcgactggaaagacgctggtgccgccggtgatgatcatgtcggcaaggccgtctacgatgtcgatgtggaagtggccatcggattacaggtggcggataatcgccaaattaaaggaatccaacgtcggttgacggtagcggtaaagccccacccagatagcggtagtcagtgctcatcggtgcgtgcagatacatgtcgccatcttctaccggaccccagcggtctttgttcggcatctagaatttggatatcggtattcgagaagtcgcggcctacgttgcccggatgagtgagccactcgtcgctgcgcaatgccgtgagtcctcgggttcttagtgcctgtcgtaggagatgacaatctgttcgagactgagtagttcgagccagctatgcaatagccggttggcatcacggcagcgccctgcgaggataaagattaaagatgacgttggacaagtctcgtttagtccgatgtcaggcagggctacgatactcgccagcatggtcggcgtggccgtgaagttggtaatctgataccactcgactatgttcacaaccagtgtcgcttcgaacttttcgggcataaccagatggtcgtctcccataagagatgaggagggtggcgaagccgtttggtgtgatgtatcggcacgggtaccaatggcttgctgcctggaccactggcgtccaggtcgatcagaacggctcgctgtgctgagggatgcggagcgacggggctaaattaaggatcaccttggtcgtgtcggttgattttctgctgaaaattcctttttctgtcgggaaattgcttcaggaattgggctttcggactcgcagctgagaatatgcataggtgggtgcatggtagaatagtttctattcctgtcgcagggtgcggttatcgctgtccaacatcaccgagcggttgtgctacgcagaggacagtggctgtgacggaatagcgttcattgatcatctcgaggttcccgggctccatgatgaaaacatctgaaatgtgatgggaattacgaccttggtagcggtcgggccttagcgctgaagatcggtcatctgatgctatgcgacgcgttccggtatccgacggtactcgctaagcacgctatcatcctgccggctgcgttcgacggcaaattcaatttcagtctaggttcgtggttgtggtcggcggagttcgccagattcgatattatccagtaggacccggtggaccgggtcgagcaatttcggaagccacctggcgctgaccacgcagtattgggctgacggcgacaagagtcagcgttccagaccggctcgtcggatactgctggttctgggtggaagtggtcttctgatgatgtaattctttgtcgggtaataggattggtggaacctccaggagaatcatattgctcggttgccccggctggctcaggcgacggggcgtactggatctcggtgcagcagatagcgggctttgttaggtcaagtaactattcggctgctgtgcatgagctgaacactcggctattcggccacctgggcccgggactcgtctgtggtgacgccggatgaattgatcgcacacttcgcgggcttgacgatttatcgggtggagcttttctacgtgtggtttgccgatttcgtagtcggtttcgctgcgcgagttcggtgaattggtgatcaaagcattcggccgagtggaacggcatcgagtttcggtcggggcacggtctgtggccgagcgaaggggccgcgctgtaccgaccgcactcagccggatctccggcagttccaatgatgaatgggtcgacggtgtctaattaggcaacagctttggtgacgttagacacctggattgcgtccaccttgacggggacgtcggtcagcatctcggttttacctgttctggccgtcacgatgtggacgtcgatgccattccggtcgacttcgcgccaatgcccgggcgaacgtattcatgccgtctttggatgccgagtagggagtccttttggctggtataggctcgtgtgccgctgacgacgagataaacatcaaccgcgaatccgcacgcatcagcggcagcggtcattacgaaacacaaatccagtctggccgagccgattgcctgccattgctcgagtgtttgcttgtgcacgtatgtttcccagcttatcggccttgtgaaagataaggtcgaccgattccagtgtgtttatggcatcaggtgattccgctgtatcggatgcttaggtcacgatatggtggttcacgatctctacggagcgtagcaagacttgacgtcgctccgccaacatcatgtcgtactttagctcacatagcctgcgaacacatgctttcctgaccctgtcgttgctgtcggtgagcagtgcggttctggtgttcaagggcgccgaatatctttcggatgcgacaattcctgcggtgaaagcgcatagatccgttgttcgtgtccagcttgacgacacattaggtctgggtgtcggccagcggtccggcgtgcccggtcgacgtcaccttcggtgatcgtctcagcgaacttgatatgcgtgttgagcccggcacggcgcttcgccagcgatgggtaagttccccgcgctgagctctcgttcgactactgccgttcatggctggtccacagcgtctctaagctgcctactaccgcgatgtatggtgtagttgccgcggacgatgagatcgtggaatcgacacccatttcagtgaagagcaggctgtcttcggggtgcatagcgatggaatcattgattttacttaagttttggcactaagaatatcctcgcggtcgtgctactgggctgccagtgcggcgcaggcaggttcgagttcctgtaatgccgcgccgaggtcggcgagcgcgattgacttactctgcagcagtaaaccaagcatgtaagcggcgctggtcctggttggtgtgtgcacaacgacgctgccacggttgcctcgccgtaacgagattagcctctcagtgtccatgatctgcagcgcttcccgaaatgagagcaagctgacgtttaacggttcgacgagcgcttcctggcgcggcaacaggttgccgtcgatgatctggcagcacagctcgttcagctacgatttcgtctatcctcggtgtcgacaaccggcgacgggcgtcgtcaccaagtgctaaggcgatgatctgatcctcgcaactcgatttaatttaatgatgtaatttattacatttagtgatttaatttttacgtggtgacccgcggttcttgctttagctaatttaacaattatattgtaaatagttgcgtgagttgcgggtccgacatccggtcgatctcgcttgactagttgtgtattgtcgagatcaatgacctgattgtcggcagttattgcagcaaactgttggtcgacgttggcgcagagctacgtaaagtcaaactgttgcaaggtgattttgttgtttcggtggctaccatccttggatagccgggatttcccgttgttcagctatctcaacgtgggcaggcgcagaatgacctgttgggtggattccgacctataccgcgccgcactcgctgccccgaacgttatagtgctcaccgaaagctgatcgcgggcagtggccctggtaatcgatccgcagcggctgctaagcgtctttccgcaggtgatcatagtcatgatctccgatttcggctgaatcggtctgttcgctgatcacgcggcaaccgagttaatgctgcagagcctgggcctactcgcctgccgatcgatcggggagtatgtgggcggcgtgttaggtgcactggccgcgcgacgccgcctcgagtatggcgatccgggtgagaaatcgcgaccttgtccaaactcgaggcgatcacgttgatgcagagtagcaaatagctgcattccgcagttgctgcgagttcctccggtccgccgctctctcgaagtaccctacgatcgaaccgacctggtacggctaaggtgggatcaccatggccacgaagtccagccatggctggacttcgtggccatggtcgactgccctgaacttggcggtattccgtagctgcggtttcagatcagccgatgggaataccgcaacctgatcaaggaacggattggtccctgaatggcagaatgaatcatctagtagatcgtcggctgggctaactgttctgcctaccgatctcggcgcaggggtaacggttacactgcccgagagacggcccacctgatcgaccgcggggtgttggttcgtaaccctctggttttcaccagccgctcctgtcatggttgagtcaaggtgcgtatctgcggtgcttgtccgcaccacagcacgctgtgcgggcaaagagatatagccatggtaaaatgtggatctacatgtaaaatggcggcgcaaagattgcatctcgagacagttgtcgttgtcgatttggttactttttgggtcgggtccgttgctatccagcttctctgctagctgtgttcggtgccgacgtagtcaaggtagagtctatccagtgtctctataggcattcgctaattggtcggaatgcacactgaagtcgagaactggtggtagtacggttaagtattccatgcgatgaactcaattccgttaagttgggggaggatgaatcgacatcaaccttgatggtacgcatccagtacactatgatatcggggttcagtgcagaacttcctcaacggcgctggggtgcaatgcttcctgatcgcggtatcgttttatctggtcgggattcgtggtgaacgcctgcagtccaatagccagtagtgtgcttggcggtgttgctgccggtgaaggtgagcacgaagaagaattctagttcgttggcgggaagacggaatggtttttcgtcattcccggtgatgacggccgatgccagcgtccgccagatgtcgtcggatgggttgcgtcgcttttccgcggtgagtttgagtgtgtactcaaagatggtgctgtggagatcgatttccttccgccggctcagccaggcttctggcgatcgagccttcaggattcggtcaaaggaatcaaaaatctgcggccggttcttttccagcatgccgatgcttgaccgtcacccagaagtggtgttgagtggtcactgtagcaagccgagcgaaaccgggtgtgaactagcgcccggaaagcggcctgttgcgtctcaggtcggcaaacaaatcatcagaaaaactatttataacataatatcggatatatttactgtgacagcggtaattgccagtctcgattcgttggagtgtcgcaccaccacggcgttgattttcaatatttgaaatactagaaatagactctagtcgtcgaaccgctgtcagtggggtggccccgtttgcgttcggttgtgtggtatacggagtgcaccgtgacgtatactgttttggactagattgttgagtcgggccaaggatgcgtcagaacggaagttcggatcgaccggtattgcgttgtcgacttaccggttctcgacgggttggttcatcgtcggattttcctccgacttgaccgtcggaagaggaggataagcaaagatggcgatgatttgtcaggaatagcgagtactcgatgcggtgactgctcgtgcggccattctgtatgtgaccgctcaacaaaatggtgtatactttgacggcgatcgtgaacactggctcgccaccttgccgccattccggtgctagctgcatccggagatggcgagttgtttcgcgatctgcgcgcttctttcaacggcgacgatggatagcgattggtgactgtcgatcacgaaatcactgtcgaaggagtccacgcggtacgatgttgtgtcgcagcgcatacggcgatacgactctgcaggccacaggggtattttgggattaactgaatttacgagcgcggtggctggtatttctcttgccgcaattttgcctgggatgcggtaccaagccgtcatccgctcggtcatgtgcgcagtaccgctacgttgcttgacatgaaagggatttagcgctgctatccatttcagttagtacccaagtattggaagctagagttgtcagtcacagaactagagttgtctgtcacagaaggtgtccaccccgaccaggagtacggtacttggctcatggctggccacctcgacgctgccgagatcgttcagtcatttgcctttctgaggatattcaattaagaatcggcccggtggtaccgatagtcgccggtttctatacgatggtgctattttatctacagaccggtgattacggcacctataaaggattatggcataccgcaggccaccctgaatgcggacatacagcgcaatttggctaccatcgtatggctgcctaggtcttgaatatcaaagcggagccagagctgcgtcgtgggctgtccactgcgacggtgacgaacattacttccttgttcctgccaagttgatctagtcggtattagccgggcgggttgatccatgcaactggacctgaccgtaacatcaactcgagcatcgacaccagtgtgtgcgtctatttatcacgggaagatcgtctgcttcggccaaaaatacacctactccatatgttcagaccggatggacaatgacccggacgttgcgctggggtgaagtgatcgagtaggtcagcagcaccgatgagcatgtagaccggcaatggtttccgaaatatgtgtgcggcgtggaaaccaggggaggctcgcgggctcggtctcaagaatggcgcgcgatcaatttcgatagcggcgtctaccccagtatttggcagcattctaccgcaccaacagtaatgcgttgcaagcattctccggcgtgatgctgagatacccgaacctagctcatggtattaagtaaccgtctgaatgtgccgaagacatccaggtcatggtgagcagctacgtgcgatggccagacgctgtgcggcccttggtgtacccgattgcgccggttagatatatgttcgattatcatcggatgacttgctgcgcactgcaactgtggacattcttaggagagtttttggttgctgctccagcgcatggcctgccgatcgaatatgtggaccgtgggacgctgtggggcaatccggtgagtggcttcgcttgctaagagcgctcattggcgctgtatcgggattggggtctgatcgatgtgttggctacgaccgtccctaacgtcgcactagcttactcagacctgaagatcacagtggatcaggttgtgccgttgtcagtttgagctcgttgctatgcggtgcgtgagaggttgatgaaggtggttcccaaccaaaagtactagatagcaaagattctccacgatctgctctccatactatcggaggacgggtcgcccgacagaaataccggcagcatcatgacgttcggatatgattatgtcaatatgacaaatatgtgactggtggttttgacgtgattctttggtgtttctgacatatcctgtgacatatgtcggtttctcggcgtgacgtccttaaattcgctaccgtgacaccgggcctgttaggtctaggtgtcgctgccgcggcgttgtgcgccgtaccggcatcgacggcaggttcacttggcaccttgttggactacgcggccggagtcatccccgccagccagatcagggccaccggcgcggtgggggcaatccgatacgtgtccgatcctcggggtacctgggcggttggcaagccgattcaggtcactgaggcgcgtgacctcatcaataacgggctaaaaattgtttcctgctatcaatatggcaagggcaataccgcagactggctgggcggtgccactgccggcctccggcacgcccagcgcggagtgcagttacacactgccgctggtggtcccgtcagtgcacctatttacgcttcgatcgactctaatcccacgtatgagcagtacaaacagcaggttgctccgtatctgcggtcctgggaatcggtgatcgggcaccagcgcacgggcgtctatgctaattcgaggacgatcgcctgggccctgcaagacggcttggcctcgtatttctggcagcacaactggggctcccctaagggctacactcatccggctgcgaatttgcaccaggtcgagattgacaggcgcaccgttggtggggttggggttgacgtcaacacaatcctcaagccccaattcgggcagtgggcttaagccggtctggggctactggcgcgttgaacggccttgcctgacgccggtgcctgtgcactccggcaaacacttgttttcgttcggtgcacgggactgtagacttgtaaagatgcgtggtggtacgtacctcgcctctgtagcctcactatcaaaaattatttatataaactagcctcactgtaatttatataacagtatgaagtattccataacaatcttgcctcgatcaatgcagttatagctacttgaccgtaaccacctacacgcaggatgtttgtccgcagcatccgtgctcgcggtttgacccggcgttacttacaacatggctacccctatataggatatagaactcgctagtaaccactcggcgtgcaagaagggcacgtttttgttacaccttatgttttctcttatgaaatccttgttgcagccgatgcagtctgccgcgcggctcggtccacggccggtgcaccaaacacacaccggtcagctgactttcggtctgcggtttaacgtggaatcgaccggaaactgactgggcttcgcacggcagtccaggcggcctggcgaacagacaccttattaaagacgcacacagggagatatagagcgtgacgatccacgagcacgaccaagtgtccgctgatcgcaacggaaatagcctacatggctcccgtgctctggcggatcggctaaaggccggagaaccgtacgtcgtcgcgttcggtggccaaggcagcgcctggctagagaccctggaagaactcgtgtcctcggctgggctcgaagccgacttggcaacgttggtttgtgaggtcgaattgctactcgaaccggtcgccaaagagctggttgtggtgcgtccgatcggtttcgagccgctgcagtgggtacgcgcgctgttggccgaagacttggtaccgtccgacaagcacctgacgtcggctgcggtgtcggtacccggcgtgctgctcacccagatcgcggtcgggcgcgctctggcacggcagggcatggaccttatcgcgacacccccggtggggattgtggggcattcccagggggtgctcgctgtcgaggcgttgaaggccgggggggcacgcgacgctgagctattggcaatggcccagctgattggtgctgccggaacgttggtggcccgccgccgcggcatttccgtcctcggcgaccgtccgccgatggtgtcggtcaccaacgctgaccccgagcggattcgccggctgctcgatgagttcgcacaggatgttcgcactgtgctacccccggtgctgtccattcgcaacgggtggcgttcggttgttattaccggcactcccgaacagctgtcgcgattcgagcgttactgccggcagatctccgacaaggaggaggaggatcgcaggaaaaagatccgcggtggtgatatttttgcgccggtcttcgatccggtgcaggtagagataggcttccacacgccacatctggccgacggtattggcatcgtcggaggctgggccgagaaagtcggcctcgatgtcacgttggcccgggaactgactgaggccatcctggtgcgcggcgtcgactgggtgcgcgagattacccgggtacatggtgctggcgttcggtggattatcgatctgggtcctggcgacattctgacccggctgactgcgccggtgattcgcggcctcggtgtgggcattgtgcccgttgcaaatcgaggtggtcagcgcaccctcttcaccgtcggggccgttcctgaggtggttcgcgcttggttgagctacgccccaaccgtagtccaacttcccgacggcaggatcaagctctcgacgaagtttacccggctgactgggcgttcgccgattctgctcgcgggcatgaccccgaccaccgtcgatgccaacattgtggctgctgcggccaacgccgggcactgggccgaactggccggtggtgggcaggtcacggaagaaattttcgccaaccgcgtcgagcaactgtccggactgctcgagcctggacgcacctatcagttcaacgcgttgtttcttgacccgtacctgtggaagctgcaagttggcggcaagcggttggtgcagaaagcccggcagtctggcgcagcgatcgacggtgtggtgataagcggcggtattttagatttggaagatgccgtcgagttgatcgaggaactgggtggcatcggcatcagctatgtcgtgttcaaacccggcaccattgagcagatacgctcggtgattcgtatcgcgaccgagatgtccaccaagccggtgatcatgcatgtcgagggtgggcgtgcaggcggtcatcattcctgggaagacctcgatgacctgctacttgccacctattcggagttgcgctcacatgccaacattactgtttgcgtcggcggtggcattggcactcccgaaaaggcggcggagtacttgtccggacgttgggcgcaagcgtacggcttcccgttgatgccgatcgacggtatcctggtcggcaccgcggcgatggctaccaaggaggccactacctcgccatcggttaagcggatgctagtcgaaacgcaagggaccgaccagtggatcggctccggaaaggcccagggcggcatggcttccagccgtagccagctcggtgccgacatccacgagattgacaacgctgcctcgcgttgtggtcgactacttgacgaggtcgctggcgatgctgaggcggtcgcagaacgtcgtgacgagatcatcgcggcgatggccaacaccgctaaaccttattttggcgacgtttcagagatgacctacctgcagtggttgcagcgctacgttgagttgacgatcggcgagggtaactcgaccgccgacactgcgtcaccgggcagcccatggctggccgatacctggcgtgaccggttccagaaaatgttgcaaagagctgaatcacgtttgcatccaagtgatttcggtctgattaagacaatttttaccgatcctgtgttactagagaaacccaaccaggctatcgccgctctgctgaagtactacccagacgccgaaaccgtccagctgcacccggcggatgcgcctttcttcgtcatgctatgccagatgctgggcaagccggtcaacttcgtgccggtcatcgacaaggatgtgcggcgttggtggcgtagtgactcgctgtggcaggcgcatgatgctcgctatgacgccgaccaggtgtgcatcatccccggcattgcagcggtggccggtattacacagatggacgaacccgttggtgagttgctggaccgcttcgaacaggccgccatcgacgaggtactcgccggcggagcggagccggtggtggttatgtcgcgccggttgggccgtgccgatgtggccggacctctggccgtggtgcttgacgcacccgatgtgctgtgggccgggcgcatcgctaccaacccggttcatcggatcgccgatccgaatgagtggcaggttaatggaaacctcagtgcgacacactcatccaccggtgcccagttgcaggtaaagtccgaagaccagcaggtagttctcagcgtcccggtgtcgaacggttggatcgacatcccgtttacgttgcctaccaacaccgttgacggcggtgccttgctggtatccaccgaggatgccaccagtgccatgcgcgcagtgctggcaatcgtcgctggtgttgacgggccggagttgctgtccccggttaaagacggaactgctatagtcacagtggactggaatcctgagcgggttgctgatcacaccggggtcacggccaccttccgggagccgctggctcccagtctcgccactgtgcccgacgcattggtcggtgcatgctggcccgcggttttctcggccatcggctccgcagttaccgaagccggtgttttggtggtggagggcctgctgaatctactgcacctggaccacgctgtctgtgttgttggcaagttgccaacagttccagcccaattgacagtaaccgcaacggtttctttggccatcgatacagacatgggccgtgtcgtgcccgtctcggtgaccattagagacacaaccggagccgacggcgctgtgcttgccactctcgaggagcggtttgtgatcctcggacgcaccggcaccgcggaactcaccggcccggttcgggctggtggagcaatatctgagaacgcgaccgacactccgcgccgacggcgtcgtgacgtcacccttaccgcaccgattgatatgcgtccgttcgcagtggtgtccggtgaccacaatcccattcacaccgaccggactgctgcgctgttggcaggcttggaatcgccgatcgtgcacggcatgtggttgtcggctgcagctcagcacgtggtaatggctaccgacggacaagctcgaccggcggcgcgattgatcgggtggactgcacgattcctgggtatggcccatcctggcgacaaggtcgactttcgtgtcgaccgcattggaatcgaccagggagcagagattttagaggttagcgcgcgcatcagttcgggtctggtgatgtcggctaccgcacggctggccgcgcccaagactgtctacgcgttccccggccagggtatccagcataaaggtatgggcatggatgttcgggctcgttccaaggcggcccgcagggtgtgggacgatgctgacaaatttactcgtagcgggcttgggttttcggtcctgcacgtggtgcgtgacaacccgaccaatatcaccgccaacggtgtacattaccaccatcccgatggggtgttgtacctcacacagttcacccaagttgcgatggctacggtggcggtcgcgcaggttgctgagatgcgtgaacagggtgcttttgtcgaaggtgctatcgcctgcggccattccgtcggcgaatatacggcattggcctgtgtcatgggagtctatgagctagaagccttgctagagactgtgtttcaccgcgggtcgaagatgcacgacatcgtgttgcgcgacgaactgggccgttctaactaccggttggcggcgatccgaccctcgcagatcggcctgcccgatgatgaggttcccgcgtttgtcagaggaatcgccgaaagcactggtgaattcctggagatcgtgaacttcaacctgcgtggctcgcagtacgcgattgccggcacggtccacggcctggaagcattggaagccgaagtggagcggcgccgtgagctcaccggcggtcggcgctcattcatcttggtgcctggcatcgacgtgccattccactcgcgggtgctacgggtcggcgtggcagaattccgccgttcgctggaccgcgtcctgccgcaggatcaagatcccgactggatcattgggcgctacatccccaacctagtgccacggccgttcacactggctcgcgacttcatccaggagatccgggatctggtacctgccgagccactcgacgatatcctcgccgactatgatacctggcgccgtgagcgcccgagtgagatggcgcggcgggtgttaatcgagctgttggcttggcaattcgccagccccgtgcgctggatcgaaacgcaggatctgttgttcaccgaagaggccgctggcggcctcggcgtggagcggttcgtcgagatcggtgtgaagtcggcgccgaccgttgctgggctcgctaccgatacccttaaacttcctgaatattcccacaacacagtcgaagtgctcaacgtcgagcgtgacgccgcggtgctgttcgccactgacaccgatcccgagctagagccggagccagaaaacgtatcggacgcttccgccgctttaccggcagaaagcgcgttagcgctgggaactgttgcgcctgctccggtggtgccgtcgggtcctcggccggaggacatttcgttcggcgccgccgacgctacattggcgttgatcgcgctgtcggccaagatgcgcctcgaccagattgaggagatggactcgatcgagtccatcactgatggcgcgtcgtcgcggcgtaaccagctgctggtagacttgggttctgagttgagcctgggcgccatcgatggcgtcgccgaggcggatctagccgggctgcggtcgcaggtgactaagttagcgcgcacctataagccttacggtccagtgctttctgaattgattaatgatcagctgcgctcggctctagggccctcgggcaagcggcccggcgtcatcgccgagcgggtcaagaagatttgggagctcggcgatggttgggttaagcacgtaacggtcgagattgcgctgggaactcgtgagggcaccagtgttcgtgggggacccctgggcaacctgaacgagggtgcgttggccgatgtcgactccgttgacaaggccgttgacgcggcggtcgcttcggtcgctgcgcggcatggcgttgtggtggccctgccgtccgcgggcagtggaggaagtgcgaccgtcgacgttgcagcattgagcgaattcaccgatcagatcaccggacacgacggcgtgctcgcttcggcggcccgtttggtattgggtcagctgggtctggatggacccgttactgcggctccagctaccaccgacaccgggctcatcgatttggttactgctgaattgagtacggactggccccgtttggtggctccggtgttcgacgtcaagaaggccgttgttttcgacgaccgctgggctagtgcccgtgaggatttggtcaggttgtggctgaatgacgagggtgagattgaagcccagtggtcgcatctgtcggaaaggttcgagggcgccggccacgtcgttgctacccaggccacctggtggcagggtaagtcgttggccgcgggtcgccagatccacgcgtcgctgtacggacggatcgctgccggtgcccagaacccggatcgaggtctctacagcagtgaaatcgccgtcgttacaggagcttcaaagggttcgatcgccgcctcggttgcagcacgactgctcgatggcggtgccactgtgatagcgacaacgtcgaagctcgacgaggaaaggataacgttctaccgtgcgttgtaccgtgaccatgctcggtacggcgccgcgttgtgggtggtcgcggccaacatggcatcctattctgacattgatgcactggttgaatggattggcaacgaacagacagaaagccttgggccacagtcgattcacatcaaggatgcgcagacaccgacgctgctgttcccgtttgcagcgccgcgtgtgatcggtgacttgtcggaggccggtgcacgctccgagatagagatgaaagtgctgttgtgggcagtgcagcgactgattgttggtctgtcgaagatcggcactgagcgcgatgtcgcgtcgcggctgcacgtggtgttgcccggctcacccaaccgcggcatgttcggtggcgatggggcttacggcgaagctaagtcggctttggacgccgtggtgagtcgttggcacgccgagtcttcgtgggcggcgcgggtcagtctggcacatgcgctgattggctggactcgcggcacggggctgatggggcacaacgacgttatcgtcagtgctgtcgaagaggcaggcgttaccacgtactccaccgatgagatggccgcaatgttgttggacttgtgcaatgcggagtccaaggtggctgcggccggcacgccgatc

SEQ ID NO: 651 - DNA, 33719 bp, Mycobacterium leprae
gatccatcgggaccggggagggccgaacggtgggcacccacaccatacgactgaagaattcttccgctcttgtattcgagcactccggcctgttcaatcgcataaaccgcaacaccggacagtatcactacctgccgaataccggcgaagacgaagtactcgtcgaaaaaatgggtgcacacatgccggcagtcacagctaatccaaggcacccggtgctcgcgctcatcgccgtccagccaggccgggttcgcgtcggctagccgggccccaccactcgaccggcgaacgacacaagcatgggagccgaacaggtgacgaatcagtgaattagtgccaagcacttgcaccacccgtgaggcagcacccccaacgcgctggcgcccacgctttcggtaatgacccagttaccaccagtgctacacaacaccgggaagccgtggatactagccttgtcgtgatcacactacgagaataagaatttaagtcaaagctcactatagtctatagtatagtatgccatacttaaactatattgagtctcttagcccaccagctaggcgttggaccgctagagccgctagagtgcgccgcttagctggtgggttaacgtctcggtgagagcctccatctcttcagggctgagcaaatagcctgcatacagcccccacaccgcacaacactactagcaaggtctcggtcaagggatacgcatcgatgtagctggcaagttcgccacactcgatggcatccttgacagcccagctcagaaaatctcggctaagccgtacggcatcgttttcggtgcaactcaattctggatgtcgctgtgattccagcacgttggtgacgaggaacgccgacacgaacggagcggacggattagcggaatgcgcttgcatcgcaaggttgatgaataccgacaccggcctaagcagggtcgtctcccgcttagcctgatcgatgctggtcgcaataaccaattggttggtttggtccaccacctcgctgtacaatgcccgcttactggaaaatgtaatgattgatcgcgggacaagtcaggtcagcacggacagcaatcgcctgaaaagtcgccccgtaataaccacgttcactgagacacttcgcgagcgacgcgcacaatgcgcttgcgtgtctcgtcggctttcgccgctgggggacggcctggattgcgactcaccctagacggccttgctaaagtgtgccaccaccgccgcgatgcggcatcacacgttagctggaatgttgccgaacttgccggaccggtagtcgtcaagcacttcgatcaattcagcacaagagttgatcacaaatggttcgcagtgaaatatcaactcgcgaatcggcagtgcgaccagcatcagtacgtcgtacgatttggtctgccttaactccgacggtgattcgatcggccgggcccgggaacggccaaccgaccctggttaaccagatgagcgaccgggacgaggcaccagctaccgaacaacacatacaccaaatgcactacagtcgggccaccatagcaatgttggcgtaacctccattttagatcgtggcgtgcatgcagtgcgaccagcgtgtgggtaacaccaaggccgcggcggacttcgaattccacgacaacataacggaccagcgcaccgccgtctccccgtcggggagcagcgtaacattgctggtttcgatgacctgataccgacagaacgtgaacttgtctttgctggacaaactcaccccagagctgaacgccgtggatgatggcgggtccagcatccacggcgtcgcgccggccgtgataagatcgccccaccatgagaatcctaatgcgtgaacgtgccgtcgatcacattaagtgaccgtttcgaagcatcggcacagatgccaatcggtaccgggaagtggccggctggtactccacttcacctaatggatccatatgtccagttccgcgctgctgaccccggctaacgcccggaacactggaaaagcccttaaccttcatagcccagccctcgcgggccgatggtgatcgatcggattggcagctcggcgtcagcggacccggccgagtagatgtccagctacatcactatgtagctggacatctttacctcttcacctagcttattatggttaggtactcagcaccccgttccgtgcgataccaccgacggtgagcaccaagggtgtataccacgccggtatagcgattgtctgcaccttgctccagccgcgtgggtcgttgagcattgatacgtcaggcatcagggtgaccacggctggggcactgctgtggtcattgatctaggttaaactcgcgccagaagccaccgatcacagcactgacgaagccattcaggcaatacacggcatctgcagccggagtggtaattggtcaagatggtggtcaacgcactcaccattggctccgggggttcagctggacgcgaagaccccacggccccaatctccgctggcttcgctttgttgctgacacgacggctcggcctgtccgacaagaacggccggatcgcggcagcgttgggcattagcacaatcttcacagcaccgctagacgatgggagtatggcggtatcgatcgtctaccgcgacaactgcgaccaccgccagctgatcccggggttaattacccctgggagagcctacgcagtgcatggatcggtgttggatgttacccttcactggtcaactacatcaacgccgtgtatcgcttcgaaaaagcgtgaccgatgagaaagtttgtggtgataaaatttggctgcgacagcagccgctacctgtacgacttaattacacgcgtcggtgctaatcacttagcgaccttcgcggcgggcaggtactcaaacccaccctgggtggactcctgggactgctagatcccgggtcttggacaatagttatgactggacaccgctcggagtcactaatggcggtcccgtttgttggcttgtagcggtactcgcgatcactaaagatcgtcggcacatcagtgtcaatcagcactagcagctcaggatagttgtgcggactactccgagtactggatgccccgggtatagcgatttctgctcgagtagatctttcaacgcatagttagacagcttgccgagcgccgctggcaaatcatgatcatggtcgcggagatgaccaacgcattctcgaagcagtgcagccacctaaaccagccgtggtaggcaagcgaaggcagcactgaaccgaccagttaaggctgaattgcccaacctcaacgggccgttaccagggaacgtaacaatgcgtgcacccttcaccttatgattccaaactccagcagatcacagattcatcgtacgttggaccgcaaactatttccctagacaggatggcaatgtgacgacgccgtttgacgacattcaggtcgagctgacgtgaaccgtgcctacagtgtctatgtgacgtatagtgatcgagactaaggtttcgcggtgctcagcgatgactccacctgctggagcagcgtcacccgagattcgttcgacaagcagactctccggcatcgccatcgagcgaagcaaacagatcttcgagatcaacatcgaacgatgcgctgcaccaattaaggcgacgccgggatcgttgagggggcaggccgacagcatcactcccggcgtgcggtacgacagcacctgcattttcagcttagacacccgtgacggacttgtgtcgatccgcgaatacagcggcaccggcaacggtcactccgctgtagtagctggcgtcaattttgaacgggcagtaagttagctggtgtcggtgtggaactaagccggacggtgacgacgattgagagcttaacgcttcccaagtcacacgggcagggccagtccgaactcatagcgatggtattgcgccatcgtccacagttccgggaccggcctacctggagttgagagcttacccgaccaccgacatgcaggcgacaccaggttgaatatgtcgctgtcaaacaccgattcgacgcaccaaaaggcgcgacgccgaaaaagcgtacacaatttcagcgggactgacgatccaccagcaaagtttggcgcaggttggacgaaccaccgcattgatcacctgggagcgaattccgaaagtgttgaatacgtcgaaccgcatagccggctcaccggaaaacgctcggtgatgtagcgtagcaacgccaatcgttcatctttcgacaagtacaccataataccctcagcaatgaacaaggccagaggcgcggatgagttatcaccgccagccagaacaaaatcggtcaccgacgtcggaaacatccaataattcgtgcaaacgagacatagctgtcggcacaacgcgatgacttcaggagagtggatatcttaccagcacacactcgcagggaattccagtctctcacgtcgagcaaccagaccacaacccgtgtacagcactaccgcttcatcgtgcacagctaagtatggagctggagcgtctaattgtcgaagccagcggggctaacaacgacttacggggtccgtagcacgtttgcttataaacgttgtcgacctacgcatagtcaatacaagccacagcaaccctcgtgtaatggtcagccagtatcaagtgaggaacatcggtgtcgaacactttggcggatccatcgacatgcacccattccatgtgcacgaacctattccgatggggcagcggcgatctttcgagtcgttccgcatcgcgacccagaactgaacatccgcacggatcgattcctcgaccaggaacgattcccaactcaactcccgtacgaccctgccgtgatcgatttctgattcggtgcacgtcgtccgcaccgacgctaagctgaggttcgacatctttgccggtgagccgagctcgcaagcttccccgtaacgcccggaccgttacaatatcggggtcgagataggaccgttgcggctgcggcacgccggcttaatcggccgcaatactcacgacttgctgcaacggaatcatccaaattcagatacatatcgctagacgagaatttgcagccgatgccgttcatcaaaaacggcagcttgccgaaaaccacgcaggaaatgaaagcttcagggtgggcatggccactaccgtacgtcgtcgagaagcacattgcgacgacgagcaggccgaacgcggccacgtaacacatcatcaaatcctcagcaggcaaactatatgggacttagggcatcagggcggtggtgacgatcacattggccccgattggcacttacccacagcgccggcccaccattgcgtagacactggtgaagagaatctgcacaagccaggctgctgaggcgcgaccaaagatattacgacgcccttcacacacccactcatgcgaaacaatagctacttgccgcgtaaccacgcggcagtgtcgactacccagcagtacacgtcacccgcagcagtccatcacctcgcgtagggtggcgacgtcgaaacaggcgcagggaaaccgtgtggagtacaagacaccgataacacaagtgctggaggtgagtcagaccatcgccaacacatcgcgtttcacaggtgtaacgttggtaacaaacttgtgtatcacatacgagctgaggaaaccgttggcgacgatgaccaatgcgagtgtggtgctcaccgattcctcactccccatagctgttctcagcgcatacagtaacactgccgcgacgttatagcgtccccagggcttgcttacagcacaactacatctacacccccgccccgcaagaaactcagcgggttagggttttagtaagtaagatagttctgttgacgacaccactgacagacggcgacgtaagtaatgatggatgtattggtcgagtaatgatggatgtattggtcgcggtgggtgtaatcccgtcactaaagatcggacactgggttgtctggtttgcagatgatgcgctcggtaggttcatcggactgatcacaacgacgaaaacgtgatcatgtggctcacggggaagggcttaatcgtctgctcaatccaagcacgcacctgatcgtgttcgggcatggcgcacaccgcatgctggatctacgtgacgtccagtgtctactgagcgatctaggagtaccatactaatgtttcaacggcccgagcgaccggtctcctggaaattctcaaatgcgacggacagctcgcaacggaagaacagccaggtagtcacgcaagcacccggaaaatgttggctaggcggattttcttggcgcaattcgatcgcacatccggtttccgaatgccgttacatctcattcgtctgagtgtaacctggctagggaccgtcatcggccccaggcaccatcgctggtaaagccaacagggagagtcaatggcaaggacaaacacccgaaaagcgatcctcgccggcggctgtttctggggaatccaaaatttgttccgccgacaacccggtgtgatatcgacccgggttggctatactggcggcggcacacccaacgcgacataccgtaatcacggcatgcacgccgaggcggtcgaaatcatctatgacccagcgatcactgattatcgcacactattggaatttttcttccaaatccacgatccgacaacacgaaatcggcaaggaaacgaccagggtaccagctaccggtcggccatcttctacctcgacgacgaacaaaagaaagttgcgctggacaccatagccgccgtcgaggcttccagcctatggcctggcaaagtagtgaccgaggtcagcctcgctgaggacttctgggaggccgagcctgagcaccaggattacctgcagcactatcccaacgggtacacctgccacttcgttcgtcccaactggaagttgccacgacgagcccccgcagacgcaaaagccgacagctgatcggctaggaccccaggcggtcagcgttgacgcaggatccactcgcccgccatttcttggggtgtagactaccccgcgcaagtgctatcgttcaccaggcgccgtggtggtatctataatccagtagcgcaacaccattttaagcaccacattcattccatctccatcttggcaaatggacacacatcggctcgtgccgccgctgaacggggatccacgcgaaggaggatggcttgtgttcgacgtaccgccgcggatcgcagtgctccgagaccacggacaggccagtaaatttgcgcaatgctaatcaagatcgaatcctctcggggaatggcccattcgctgaggtggtacacggacgaatagacgcgacgagcggcgaaatcgatgaccgtcctggtccactggactcccaggtatagtcgcctgacgcagcgcgggggcaggatcatcacctggcattgtcgcccccatcgatgatggatcggccagcacccccaggtgctggctcaacaattagaagaggccgactagagtggccgcggtgggatggagccggcgcagttcgtctagttcggagccgaaacctgcgcgcatgatgacattgatcgtgatccgattaatcaaacggcagtgtggcaaaaggctagccttcaggccagttctaagcccccacagcggctctgcttcgaagatacgcacgtgattcttcatgcacgtgccgtgcaaacggcggcgaagccgctctgccgtagatcgggagtcgagcatgaaaatgtcgtgattgcagcgcgcctggcgttcgacggtccatcgcggtaacacggcaacgccaaggaacttcaacacctttgggagccggtaagcagggaaacctaaattaaaaaccgtagcgatcgctaagatcagcacccgaattagggacggcgccatactgtaccggcccattggccctaacacggtgtcttgcggaaccaagcccgacagagcctcaaatgcaccgaaaagagctccgtaaatgacttcaacaacaatttcacgtgcgacgcggttctgtgctacaccaaacccttttcggtatcagctgccagacaacctagccacctcgatcggctagcgttactgccgagcgagcacagcacacagcatagtccgacgctcgaaccccttggttgcacgacattgccgaactcgcttaggtagtataacgggcgccgaatccaatttcgcccggaatcgccctgtcaacaccgaaacatgattagtcagcacatggccgcaccaccgcggtggaggacttctgtccacccactacagaagcatatctcgggctgcagcgaatgccgcgactaggtggtagatgaacgcactggtgaaatacgggacatgagatgatggcctggctgcttgctgatcggcgggatgcgtgggcaacggcggtgcatgactaaacctagctccgcatcgtcaacgcccacaaaacacttgcagtgcgtagatttgttggatgtcgccatgctggatatagcaccgtcactattgcagtccatgaacagctttcaccgcaaaatttgggcagcttcaccatcgttggcatcggtaccgaatcgatggacgaccgcgccctaattacacttcatgattgaggggctggcagccgtcctactcggtaccaccacctggcgcagtctcgtcgtggccgagctggtgtggaccgatgtgccctgcgaccgggtcgattgttcgtggtcgcggcggtacggtcccctatatgtatgtagaaatatgtatgtagaaatcttcctctatagcggccaaggccctaacaaaacaaccgggctagcggcattctgaacagttccactctcacagttttaccaaacagtttccgatgatcctggaagcagatcgcatattgttgagaactatgaggttgtaaggaatacgtcattaagggtgacggtacgaagatgtcgtgaacggatgatgtcgatgagctgcgggtagacgtgggtaaccggtaggtggttgagatgtccgatcacgatggcttgcggagtgaaatactggtcagccatcttcacgatgtaatcctcggtgatcagcgtggaatccgacagcgaacccgaccataaggttggaacggtgtagccgagatcgaccgccaccgcatcaacagtggcgttgtgcttggcatacggtggacgccagtacggttgcgcggcgataccgtagttcttcttcaggaagtcgtcgttgcggttaagctgtgtggctatctcgcttttagtcattgctgtcagatccgggtgagaccaagtgtggttgccgagttggatctggccagattccaccaacggtcgcaacatcgacatgttgtcggtccaggagtcgtagactccgttgacgaaaaacgtcagccgtatgtcggtgtctttgacaaactgcacgtaggaacgcactacctcggtattgacgccgtcgtcgacggtaagagcaagcagatcgccacgacccgggatcttagatagcacaccaccgccaggcaatggaatgcgtgcactcgttggtggcggcggcaatacacctgcggcgttaggagtcggcgtcaactcggcaaccaccggcgcttggacgaatgttcgcggttgcgggccgaccacgaggcgtactgcgccgaggccggtcacagtggacacggcaagcgcgcccaaaaagctacgccggtttagcgctgacacagcaaagcctcgagcacacgtatgcaccatgacagatccagcaaacccaatccggtcattgtgagatggtttgcggtgcgatacacgatagacaagcccgcttgcgggatgctcatgtcaccgacgtcggcctccacagcagcaaaccgtaccactaacagggaaaactatgccggataagttgcggcaggtcagccactgattgaagattcaatagttgaccttcaatgacgtttccaccatcatggttgagaagcgttcgagtccggttttcgatacaggttccgtcgcggcagcgaatgttccacattaggtaaccggtgactagatgacgggctcttactatacttatttaagatgtattgaccacggtgcagagtgcgctgctgtggagccgcgagcgattcgattgtgggggagatggtggaattcgagcaccacgacgccgctaccgcgccaagcaccgatcacgtcatcacgtgtcgtccaatttggctctcaatgtatcttggcagctagcttgctggggtgatgaggaccggtgacgtcgttgtcgacaaggtcgagtcggtggattgccctcttcgcattcttaaggaatgtggccgttgctagccgtggggttttcctgaaatcgacaaggatctgcgccaataccgattcagcggctaggtacaccgcgcagcgtgccgattcaccaagtctataatcggccaacacactacagtccgtactgggtcatcctgagctcttctccggcagtaatcatcgtcgaacccgatgcacttggctgatggccgactgcctgttgggtgaccagaccagaaacgctacgaattgattagctacttccgttgaaacactgcctaccgcaatccagccgtaggcgtcgtaagtcgccggggtcacttgcgtaggtatagcatccgatgacaagaccggcgcacgcttgctacccatgttggagccgcaaggttgtccacactttcccgctcgatcagcgaatcagcgctggaattgacgaccggccgatctgcagttattacgaaaagatatttcgccgcacatccgatcgcgggctcgtgagctttcctagtcgtcgaactgtatccgatactaaacaattgtcgagctgcaagtcatccggctgcccgaattactcaggcaccccagagttgcggggcggcaactgtacaagctcggcatcgggggttcccagcactacggccagcgggtggatcgcgcggcgaacgccggtgcgacaaatggccagttaatgtcttccggactgggtaactaccacgcaattgatcccattggccgcggctggtgcttgaggacactccggtgggttaggacgctaggcaggtgaccatcgaaccagcccgaaaccccggtgtaatgaccgtaccgagtcatgaccatgatcgtgtcgaggcaggtcaggcagcgaagttgctgccaaacaacccgacgatagcttggtcctttgtgcccttgttggggcgtaggtcgtcgacgatgtccccgacgctggtgacggcggtcgcgctgaaaatgtctggatgcatgacggtcaagtcgacggcgcaagtaccgcccatcgaccagatagcgataccccagttggtcagaactgcggccaccccgaaattcgggggcatgaatggcacaacatcttccgctagatggtcggggggcgttaccgcggatcccgttgacgcactcggtgtcggtgtcgaacgagccggtggggtcaacgaacatcagcgtcggagcgaagccgtgatgacaggccgcgcggtttgtcgatggtgtcgaaaccgcccctagagcgcagccagtacgcaggagtgttaaaggcagaactatgatcatcataactggcggcagctggtgagacggattgcttttgaaccatgccaggggcgaatacatcagttcctggcggtgggtaaaaccggacgcggcgaaactatgtctaccggcaccacgacacacttggttggcttgatcccggctatctgcatttcggtgacatgcagccgatcgatctgatcaggcaagggccctgccgtcaattgattccaggcaacttgcaccgtggggaaataaccgtcccatagattcaagaccaaggttgcgcacagcggcacctacagcagcgccagaccacggcgctaacagcgggcacctgaccagcccagcaacagtacggccgcagctagcccacttaaagttacccacagccacaacgacttttgtgctgggtccccagcaaccccaatcgaggtgacgtaccaatacgccagcgccgtcacagcggctgcgacgcctagcacaacggtagtgtccgtttaagccaacggcgcctggcccattacctatcgctttgataaccatgagcagagcagaaccttgtacgaccgccggcaatcagtcgtgcagcaagaacggttgttcggtaataggagcaacaatcgtagctttcgttaaatccactgactgcgcggagtcggatggtacaaaaacagagccaaaggcgattactctactaccagaccagcaccactttagacctagtctaaagccgctgaaactgcaattcgattgattcatcggtcaggtgagcgtattgaactttaagcaggtcgccccagcgccgtggcaaagttagcataagccaacaggattctaactcatgctggtgaccaagcgcagacttatgctattgacgacgatcaaagctctgaggaacaccatcacagggccagccagcaccagggatgcccactgccagttgcggcaatgcaatacaggaccgggatcacggccatggagatcgctggtacgacgagcacgttctcgacgaccaggtattgcctagtgagatcagcttagcttggtaagccgcctgttctgtcgccgattataccgcatgttccggtatggaattctgatggtgttgcgggatgaggtgaagtttagccggtcttttcgatttcggtgaacaacttatgaggatcatagcctaaagtgactgtgacggtgtctttttcggtagtgtagtttacgatggaatttccccagacgagattattctagtttctttttcgatgcgcgtagcgcacgaggcatacataattccggtgatcttgagctcgatatggctcatcgtggtcggaggggcagttatcttgggcatgggcgctctttactctggcatgccaatgtacatctggaagtttgaagcagagcaggcgattacgccgcgcacgagatctacgatcgcagcgggaacccggatatcgacatgcaaccaagccggcttcgttaactgcatccagcactgcggcttcctcaatcggcctcaatcggcgcagaaactggtggcgatgagccggcccgtcgtccgggcggtcaatcgctacggcttggataccaaaatcctgcctatctggcgctgaatggacacctcgcaatgccaacagttaacccccggttgctatactgttagtaattatagcattcctgcacttaaatacccagccgaggcaagcctaacaataaaattgtaaaccgaaatagggtatatctgtcaaggacgtcaccactgttggcaacagtctggcatccccacacatcaagtcaagccgccaaccgaatgggatcggactgcccgccggtggccggtgttggtctggaggcgggcagtgctagtgacaactcgatgcatcgtagcctcaacttggcactgtcgtagtcaacattagggataaggacatcatgactgtcaccgttgtcgatacggcaccaaggctgccagccaatctgttgaagtaaccatgccagtcgccgaattctatgcgattgtggccaatcaccagcgccaccacgaattggatggtcctggaacggtaggtgacagcatttaaaatggaagtagaagcaaaattaattgcaggatcgaaagaccaaaatgaaaaatgcatagtattccctaccgaatcaccagtacggttaccactcccaaaccaaacgaatttagtaaattagcaaaggggtgccattctgtaggccacagttagcggctggaattttgagttgttatcgctgatattaccccgggtaaccaaaatattcggcgatcatgatgagcagtgaactcgaaaaccgattaaagtacctatcagtatattaggtacccggaaggtcaacccggtgagtatcgcggctacactgggaaaatttcgtgatcgctacgctagaccgtagctaatgtgtctaccaatcggcttcgaacaggcccccactgcggtagagccggaccatcgtggcgtccgtaatcggtgtggctccgcaagaacactctgatgcccgccactccttatgggaagcatgtcgtggtcagacagagctgtgtagagctctggctcgaaagggggaacatggcgaaatatccttgctgtcaatggtgccggatgtcatacaacaacgtatccgttttggagtgaccaagggattggcgggtcgggtattcctgggcagggtcatatgtagcgatctttccttaatagtgattgttccacaaaaattcggacaatgcatcggatattgcggggaggtgttcgagacggacatactgtgcgatgtggtcgacggcgaactaagttgccgagacccccgcggacacccggccctgtccatgggccggattctcgccacagctctacgaattgctggaagaacaggagtttattcactgtcgatgcaatcgctgacccagctcctggattcggacactgctacactttatcgatcgtcacttcgcgacacgatcgaaatttggtcgcgatagtgggtcgactccatgcctgaaaaagttaaccttcgatgctcaaaaggtcgtcgaattgccctggtaacatacctgcatcttaattgtacaaaatgtgttcgacgcgcacagtcggcaccctgctgatcgaatatgccctcttaccaggcccaacgcgctgggcgaccgagagatgtgtctgtcgggtcggctcgacaacgaatttccaccggtggcggttagttgcgcctaaaccgcactggacagctatgtgctcggctgcgcgatgcaattttccggggtggcaccggcagaaaaaagacgcagaactatcggcgaccttacagcagctgaatccttttcagctatcctgctaaggtcgctgttgccaatggcctcccggttccattagagtaagaattcgtattcggtattgcatatttattcggtattgcatattattgttgccaggctagagtaatttggcacataatcgcatgccgagaaggctgaggtgttaaagtacgatgtccgtcgcgacttctcagggggcggcctgtcggcaatcgcgcacaaaccggcagcaggatacggttgatgtcggttctttaggtgcaactctgcgcgggcggcaataagatgctgttggtcctgaacagcttgaaaaataacgtatccggcgtggcgacgtgcaggatctgctcacgcggatcgacacgtccaggtggccggcctacccgacgacacactattcgcagcgcacggagaccgtgggtacaggtgagtacgtgagcgtggcgtaaattcttccgcgaatagtccgattacgagagaccacccagcaggccgatgtcatagggccgtataatagacaaattccgacggcttgccagagttatccggcaatgttgcactacgctcctataaccatcgccgcggtcacatacgtcgacgaaatccccgtagccgaccgtcgcccccggtgctaggtacggggcaagccgcggcgccttgagcccacaccgccggcttaggttccgaaggccagtgcttcagcaacaggcggtatcctcgacggtggacaccagacccggcctgtgcaccggacatgctacttactggccagacaacgaggaactcgctgaacagctcaatggcaacacccggctgggtaaaatgtggcggtgcttggggtgcacagaattcaccctcgatgagccacacggtctcgatcatcgagaaaacgcaccgatgatcatgcgcggcaacggcaaggtgttacgccaggacgtcacaaatcgtacgcccgctgtcgaacgcttgtttcggagttgctatcaggctagcagcggatgctatgtggaaattctctgagcgcagggggctatccaagccactcttgaacgcgacagaccgatattcttctgcggcgaattcaatgtcgacccaactacgacaatatatgaggtcgattgcgagcttgacaccgttgatgtcatggtggtggtatgtggtgcgaattatttgtgtttgtgtccacacgcaacagtagtcctaacgcgatgtggatcctatatggtggctgtcgaccgcagaggcaagcctgtcgacgtcatcctgagtaatatattaattatagtcgcccagtagctctgttcgatcgtctcacccacagcggcagtaacgctacgctaattgactcgaagatccgcgtgtgtctctcttctgctggtgggtaaatatagaactcatgatgctactgctgattgccgatacccatgtgccacaacgcgcacccgacatgcccgcacaggtatgggacgaggtcgcaaaggctgatgtcgtagttcacgccggcgactgggtatcgcccaaattactcgacgagctggaatccagggctgctcagctggtcgcgtgctggggaaataacgacgggcccgaactgcggtcacgactgccggagcgagcaaacgtgacattagcaggcatgaatttcacagttgtgcacgagaccggcgcagcagacggccgcgaagcccggatgtcgcaactgtatccggacagccaggtcttggtgttcggacatagtcacataccatgtgataccacgacgacgaccggtttgcggctgctgaatcctggctcgccaacagatcgtcgccatcaagctttttgcagctacatgaccgctaatgtcgacaacggggcattaacggacgtagtcgtccacccgttggaaaaatagctagtctagtatagtaaagcttattgttagagttcaataatctacctgcctaggcgccgagcatcatcgcgtccttcggttggtctcacggtaaccagttcgatacagcgcggcgccccgagtcacagtctcaactgctacaagcttgtcggccagcagccgaggaactcggtcagcttgaccaaccacaccgcatctagcagatcgctagtgatgacgatcgacgcgtgacatcgaacctatcactatgatcagttcaacgccgtgaagaaatctgggctatgtaccgcaacaactttctgtccaacccacgttcggcgtcaactgtgttgcgccgtctcgtttcttagctacctaaatagtgcatccgctatataattttcataactttcgaagaccgcaacatcgtcccgatagccaatcgtgagttggacgtaacgaagccgagctgactcttgattgttaaccaactgcaacaatgagctcgggccgcagcagccgattcagccgcgacccctatgtttaaatcgcccaggacaaattcaaccgcatcatgcggcagtatggaagttgggatgggtagaagccatgaagttcttgcagcagatgcgaaagttgtttggcctggcggcaaagtttccggcacggctgaccatcgcagttatagggactgccctgttggccggccttgtcggtgtcgtcggcgacacggctatagcagtagcgttttctaagccgggtcttccagtggaatatctgcaggtgccatcaccgtctatgggccatgacatcaagatccagttccagggcggcgggcaacatgcagtgtacctgctcgacgggctccgggcccaagaagattacaacggttgggacataaacaccccggctttcgaggaatattaccattccggcttatcggtgatcatgccggtcggcggacagtctagcttctacagcaactggtaccaaccgtcgcaaggaaacggtcagcactacacctacaaatgggagacgttcttaacccaagaaatgccctcgtggctacaagccaacaagaacgtgttaccgaccggtaacgcggcggtgggcctgtcgatgtcgggcagttccgcactaatcctggcctcgtactacccgcagcagttcccctacgccgcctcgttgtcgggcttcctcaacccatccgagggctggtggccgacaatgatcggcttggcgatgaacgactcgggcggctataacgcaaacagcatgtggggcccgtccacggacccggcatggaagcgcaacgacccgatggtgcagattccacggcttgtcgccaacaacactcggatctgggtgtactgcggtaacggcgcaccaaacgaacttggcggcgacaacataccggcgaaattcctggaaagcctcacgctaagcaccaacgaaatattccagaacacctacgcagcctcgggcggacgcaacggagtgttcaatttcccacccaacggaacacactcgtggccgtactggaatcaacaactggttgccatgaaacccgacatccagcaaatactcaacggcagtaacaacaatgcctgataccatctaacccgcaaaccaaacaacaacccgaggcgctaggacaacagagcacgatgacaagagtgaaagtaggcacagcccagtaggcaccacgcacacgacagccgcaatcgccgacatttgggattccgcgtaggcgcacgctgatggcactacccgacacaaagctggcgaacaacaaaaatagccgcgacagtccgtcacttttccaccggcgatgtgacgttcgatgccccatctcatcttgaccagtgtgcctgtcacatatctaattgggatcgacacctcaccatctttgacatccggtgtggtcagcatgcccagaccgaaaaccacaagcagaattggagtgaagtgagtcggatttaattacatcggcccacgagaatgtcgcaccctgccgccacagcaagtcgcctacaccagctcggcatcggcctcacctgcgacagccgtgcctcgctgtcgaaaacctcacgaatcctacatccacggtttcagatacgcccaatgctcacaatgcgcaaccgcactggcaaagcggaacgaacagacccagtgaacaacctaggcagcggtgcgccaggcactgggcaccgtagtaagacttggcaaccattcggcctggaaccgagtctcatacccagcttcatagaccgccttggcgagctagtaggcgaccattaagttgtgccaaactcagcgatcgatcccgacacgaccgcgtagccttcacaaaacgcggggcggcaagctgctttcagcggcgtggtccacgagtgacctttaagcagcgtaatcgaaaaagaacaacaggcccggtcacgtatcgcgtaacagcgaatctggcacccgtccaacggctggcccggctcaccctcgaagtcaatcaacagccagctctccggggtacgcagcacctgtcccaaatgcagatcgccatgtacccgctgaacagtgaccttcaagttcgcgagcttttggaatcgatcttcgatcggtgccacgatactgcccgagttccagaaccgccgtcagaatcgtcgatgccgtgttcagtcggccgcggggaaggtgacctgcatcgtccccaagcattcggccagggtgccggaaaaggctatcggctacagcaagcattgaggtgtggcaagagcttataaagcgcatcaaagctcgcgcgatcctcggtagaggcagatagttgctatgttgctgtactccggtagccggtgcgaaatcgcaccccactatcacctgataacgctcttatgaaccgtcactgtagttggcgttgccaacatcaagtcgaggtcgtctcgaagcaaagctattaccgcaagatcagcggtggaaagctcagcgattgcgtacgacgtaccaaagttgctgttcacacctaagcaacttggctggcagagtcattgacgttaatcaacactaattgttttgctttgcgacaagttatggctttctcatcatacacggacaactggaaccagtagaacccgtgcctcagccagagtcaatagatagggttaggtggccggaacacggaaactccacctacccggtaagctggaccggcgtgtagccgttccaatacggcagattgagttcgatgagttgtgagaacagcggcaagcgatgagttgtgagaacagcggcaagttgttgacgctcagcacagtgtcgccatcaccagctgttttgcctacaaaagacgatactggcgaatgcgaaccgtgtaactcctggaaagcttcaatggcaacgtcatcatgctgtcgacgaactgtcagcattatactatgaatactggggtgaagttgagcaccgaggcagaacttatagcgttacttctccaacactgacaacgtggtagcggtagaccgaatcttggctggataggcagataaagccgctccgggttagccttagataatcgggcattgcggaccaatgtctttcctataattgagtggcatgcactccgtcgtgatctccccaaccatctcacgtcactctagtacaggaccggctagccgggcaacaacagtagagcgagtagagcggtgaacagctcgatttggttacggtcgctatccagcagtggtgccaggctgcgccagcttccgacattcgccttcatccgtggctccttggcgtattcggcatacatgtagtcgcgttcttcatcggtgaccatttccagtggcaactcgtcgtagttgcgcaggaaaatctcccactgagccatctttggaactgccggcgtctgcgccaggatcttcgagatcgggaaccacgactaccccagccgcggcgacatgaagatacgcggcatcagctggcagtaaaacgccatatggccatacggcattagtcaccaccggcggcgggcatcaccgaactacaagaccaaatcggacggccactgattagcttcttagcttcgtccagcagtacctgtcccaggaatttgtcgtcgtcgaccactttgctaccgcgcttaaggaaagcatgcttctcggaaaaattctcgcaattggcacaaatcgagctcgaagaggtagggcaccacttccagctgaaccccgtcgatgaacatgacaagtcaaaagaggagaaaatcgatcctcgcttcttgcacgttcacattgtcgtagttcagatccggttggtgataaaagaaagatatgccaatagcacttggtagcggaccgggtcgaacgtccagttagactcttcgctgtcgacaaagatgattcgagcttagacgtattcgcagaatgcgggcagcaccttatatgaaataccgtatatcgtagcagacatcatgcagcggggagtcatagaacagcagaagccagatgtagtcgatgccgagctattgccggtaatgcaagcggtctattgagtccccgcagatcgaccagcaccggcggaactaacgtagtagaacgcccggaccaatccctcgtaaaagacaacttgctcgaatcaagtcgagtctacagtcggtacaacagcgttaccgaaatcctcggcactcggatgctcgactacacccccttcgacgtgactgtcgccgcaggatgctgctcaccagcctcaacgagatggacttcgttgatcaatgaacccacaatgccacagatacccgaggcaagacaccctgggatcaggcctgagatcaagcatcgctccaagcgaattggctggccggcaggccgcgccactatccgaccggatgtcaagctggaggtccctccgctaacgtcacattcgcggtgaggtcaccgccgccagcagagcgatagttcaccgcaacggtttccccaggatgatgcggcacgagcacattcgtcatagcggtggcctcgctgatgggtacaccgtcgaccgacgtgatgatgtcacctaccgaaatcccagccatcgcggctggacccgtcgcgaccacacgggcaacccgtgcgccgttgccgttgttgtctaaaacgcccaggccaaagaaggccgtcgggcctatgtgtacggtgtttgacccagccccggaccggatggcaccgacgacctccatcgcctgaccaatcggaatggcgaagccctgcccacccaacatcttgtagttatcggtagcagcagtgttcatgccgaccacctgacctcggctgttgacgacgggcccgcccgaatcgccgggtttgatcggggcgtcgacctggattagtccggacaacgtctcttgggcgccggtcaggggttcagacgcttggacggtctggttaagtgctacgacacgacccggcaacacgctgggaagtccaccctggccgcccgtgttgcccagagccacaatcggttcgccgatcgccacgtcaccaccgattactgcggtaggcaggttactcgcgccacgaagctggagcaccgcgacgtcctgggtacggtcgtaaccaaccacgtcgacgccgtaagttttgccatttccgacatcgaacgcactgatatcggtagcacccgagatcacgtgattattggtcagcacgacaccgctggaatcgataacgattcccgtcccggctcccaccgcgctgttgtagcctaatctagtgctgatattgaccacctgaggcgcaaccatcgcggcgggattgagcggcaggggtggccggttgctgaaccgatcgagcgccaaagtggacggtccagacggtgtggctgaccctggaaccacggctagactcagacctagcgcagctaatgtacttaccagccatgaccgccagagtgaacggtggggttgtctgctcatcccgtaatctcccgcatccagctaagaactagaattgttccaaccttcggttctgggtggcatgactttgtgtatatcaagctagtgcaaattgctgtcggctacacatttgggatatcgctccggccggcgaagaacggaacgctgaggttgctgtcaaacgatcagctgtgctgacgtaacggggttaagtgaggtcgcgccgggcggggagattcccctcaccttaaggtcggctcagtgctacacacaagccgatggttccccctgtatattgtcgtcccactcaagacggtcgtggtatcggtccgagcaacaatcatctacatcgtaaaccccgcggtctgttgtcacacgattgtagtagctgagccgggtcacgataccagcgtcctcgtcgacttcgagagcggattgctaaacacgtgtgtgattcggggtgtgctatcgggataaagcatgatcagtgacttccagatcgccagtagccgggtggcattgactgtgccgtcggcctgatgcggatatcggcaggctcgaagagagcgaccgcccccgccaggtcgtgactgtcgatacgtgcggcatagtgacagaggaagtttgccatctgagtacaactctccaggccgttaacctagtgtggccctacctacaccgacactgtacgggaattcgacccgacgagctgacgtcccccggcagacccgggtcaaccaacgcaagccagtgctacggcccagtcattggtacccggccagcagccttgtgttaggcagtcgctgatgggaaagctgtttaccgcatactgttagatgggacacatacttatgtagggcgtgtgtaatggccccggaaaactacgaaaaggaaaagatctatagcggacaggagtgaatggatccccgaaacacggtagtcgttcccaccgcgagcagccccaacaacgttcgcaatgtggttctggtcggtccgtccgtagctggtaagaccaccttcgtcgaagcactaccgatcgcggccagcctgttacccagaccgggcacagtggtgtacgacagtacggtctacaactacggcgaagctgaaatctgtcagcagcggtcagtggggcgttaccctgacttcatctacttatacgacagcatcaaggtcaaccccgtcgacgcacgcccggatacaccgattttgtgggcgagctgcgagccgcagattgcacgccgttcgtcatcgcggcaaaccagggcttcggtggatagtcctcgatccgcagcaatcactaagctcggccactcccaagatgaattatcaggagacactttctgccgcaaaaaacacgttcaagaaagaaatataccactttccttcctactgaagacgacctgatcggattgttgtcacagacctgcgatcgattacaatggcggcccagagcaacggacgccaacgacccgtcggacgccgatcgtacccgagcaagcgcgcgacaccctgattgaaggaattctctaggaatccgaggatgagtcgctggtggaacattcaaggacaaaattcttcacaccgaagggttcgctgggttcgctgcacgtctagctggcttgtagcgctaacggtagttacttgcagaggaggtgaagacgacgtcagaccctacggtcggcagggtcgtcctggtacagatgttttccgagaccaccaaccctgacacgatagttcacatgtcgcgcgattttgctgtgcttcgagttcggataacagcgcgcaagcatctgggcagagtgaccgtgacaaggataaacgtatcggggtccttgcattcccactcagcggtcagcagcactccgcgcccgtggcggtagtgggcgacatctgagtgatcagcaaactagtacgagccggctacccggtggtcgacgtccgagtcacaccgctggacggtaaagcacacagcgtcgccccttcggacttagcattcccggcggcgagtgcggtggccttacggaaaacggcagctgcgatgacggttaccttgctcgagccgatcgacgagatctctgtgctgatatccgatgatgtcgtagacgcggcgatgggaagaaccaacgcaaatgattcaattcacatacgacgtcgtgttattcacccgctatgaacctatgcaggaatccgcaacgtcctgggtgaataccacgcatgtagacgtgtatttattataaaatattgacgattagcgaatttctcgcccacagactgccaaacattttgtcgtcttgggtccgctgaccgccattttggtgatccgttgcgtgctatggaccgcaacgcgacggcgactgatctagctggttctggtacttaccggcggtactctaataccttgatatcttgatcccattgaccaaacgcgcgagtctgatggttagatggttaaaatccggatcgccctgtccatcaccttgcggattcacaaagaactcggcgaaaccttgatctacatctccttgcaccgctggtagccgtgttcgctttgctaaccactgtccatattcgccggacaagcggacaaacggtgaaatgtactttgcacgagactgatcggagttctggtgatcgctgacgctgtggccacactggtccagacctatcacatcgacgatgtgggtgcgtgcagaccgagtgggaaaacgtggcttcgaacgtaactgggtcctcacatcctcacccccgatgagcgaactgttcggccacggcgcggcggtcgagcgaacctttggcggtgtgcggaagcgcgctcgcctcctgaaatctggtgggcacttcgaaggccgccaaccgatcacggcagaacaccgcaagctccgacggagtcggtgctatgacctcgcgaggaacaatcactgcggtcactgtctccccgtacaccttgtcaggatcaccaaataccgctacctccataacgttgtggtgactggccaatacaccttcgacgcgctccggcgagatcttctcgccggagcggtttatgagttccttgatccggccacggatcctcaggtcaccggttaccgacagtgaccccagatcaccggtacgcaaccatccgtgggtgaagttcgctgcggttatcgccggatcacccagatacccacgcaccactgtggagccacgcaaccaaacctcccctacggtatccggggggaggggttgaccgtcggacccgacgatgcggatctgtacgccagttgactgaccgacaagaccgtttgttacggtgggattctccccttggccgaaccattttatatttgtggttgtcacctggtgagtggcctcggtcatgccgaaagcacatatcaccggcgccaagaactcttcacgcagcgcttgcgccgtttcctgggtaaggggcgcactgcaactgcggataaagcggagtttggctcgcttactccggaaagattgagtagaagcgagttccaacaagatccgatgaatcgccggcgcggccgtgtaccaagtagccgcaacggcatcgatgtcgtcccagaatgtgcgcgccgagaaccgcgcgcgagcagggagcaacaccacacctccagatgccagggtcgacagcaacgcagcaatgagcccatgaccatggtagaggggcatcaccacgacagtcgcatcctgtgggccgagctggtacgcggtaatgatggcgtgaacggaaccggcgatattcccgtctgtccacgggaccatcttcggcaaacccgtcgttcctccagtgaacatgatcatagcgtcatcgtgccggagcccgtcaggcgtcgaagtgactggatgcaacgccgcagtgtcgtccaggtggaccaacaagctgccttccgaagcgcctgtgacgctaccgtaggaaaccgcaatcggccagtagcgcatcgtcgctgctcgctggtcgctaacgccttcaagggcaagactgtccaccaatgtcactcgcacgcccgctgcttggctccggatgcattgctcattgacaggtagagccggatctaacggcaccacaatcaggccggctcgcgacgccgctagtaagcctacaacgaattcaatgttgctagccgcgcacagcgctacccgatcgccaggcagcaggccacccagcgccagctggacggtcaaatcatcgaccagtcggagcaaatctcggtagctcaccactatgcgattgtcggtcacgacaagcgctggcgcgcttggattccgaattgctgccgcctcgaccaagctggcgatactcgggctttcgaattggccagtcagcctcgcatctatctgttcaaccggagctctgctgctggtaatcgactccgatttcatcgccgcactccttacgccttcttcgatatgaacagcgtttctcttcagaaaaccatgccacgcagttttgtcatgcgtccaataaccacccgataatgcttgatagcgaataccattgaaacggcaataatacgccgactaacaggtaaatatagtccttcgatagacgacgtggatcaccgcacagcggcttaggcttggacagcgacgagtccgccaaatcagtgtgattacatcaaagccgttgcggatcgcctacagcccgcctagacgcacacgatgtagtcgattcttaacatgcccctccctggcagcgaagcggcgacaagggcgaaaagcgcgcgtttgaccgcgttgtggatccgctcaaggtcaacggcatcgaaacaatctacagggtcgttggtatcccgatcaccgacctcgtgcgtatcgcgtaggtgcttggaatccgccacatcagcttccgtcagaagacctctgtccaacgccgtgccgctgctggattcctcgtccgacgcccgtgtgtgtctaattggaatggtggcggcacccggcttcctcaacagcctagttgccttggcaaacgccacgattaattgctttacgctgatccagacctagggtgcaagcaatcaagcgctggtggatcggcattaagaagattacgatgacctcgaccagctcaacgctgtaaagcctttcgcgaaggcgacatcccggattgaccaagcaagaacagggcgcgccatttgcgtttcagtgttgggcttcccgggcaccgcttacctcgatatccctcggttatacgatggtctcggtccttgtgctcccggccgcatccgacacaattttccagttcgtcaatctcgcgccccgtcagctgtcggagccggaatcggttgatcgcgcattgaacgcgttggcacaggagtagccccggctgttcgtactcaagcttatgcacaagcagacaacatgatgcaagccatgtcgaagatgtcttgagaagacatccacgtggatgttgatggccaaagggctatcgcccaactccatacccgcagtccgctaccgccgcgcgttcgctggccatcgtaagcaagtgcaggattggccgggtcaacgcccggctgaactggcttatcggcgacggtgaatcgccgcagtggcatactgatgcaaaatttgtttttattcaagtcgatttgtttttattcagattgatatcgcggtggcggagttcggcagcggccggctgatcgcgtcgccactggacagctaagttggtgcggggaggtcgatgctactcaacggcgcgactacgagtcggatcgtcgctcccacatattggaccaacgagctggccagatcacaaaacagcaaacggagtcaaaatccgccagtgtctggccgacgatatctcatccaatgcatttcgacaacgcactgaacgtcattcgcgatgttccgcacaatcgctcgatctgtgtctcgaccaccggagcccatatactcgccccggccagtaaattcctcaagatagagaagccagcaccgacttgacacggaaacctgggacgtgatgggtatcggcatgggctatgctattgccgacgcggtcccctcatcaacctacaacatcgatttgactaaacgctcgcgccacaacgtaatcgaagaagtcttcggcagtcaagtatattatctcataacactttattagctgcggtcgatgctaaccgaagcgatcacatcgaacggattatcaatcgttgacttcgagctcgtggcatccaaccgtggaggtgaaaaacggacgcctcgcgcgcctcaaacccacgaacgccgcaatgccgcaatatcggtcagcgtctacgagtgattcccgctaactgagcttcaaaaaattcgttcaacgccagttgcttggcggatgcgacgagcgcacgggctaccggagaacctggcccggcggagttggtggcgagtgcgacgtcggctttcagaaccggatcaaccatttctaccgcacggatctctgcgcctatcggcgtcgtccacagccaggtgtgcggaacaatgcacgcccaatttccagtcgccacttgagcgaataacgaagcgacagagtcggtctctacttgcggggtagcagtgatcgcgtgaccagcaaaggccctatcaataagctggcggtctcgcatgtcgggcgtgagtaaagccagcggcagctgcgaggcttctggccatgccaacaccgacgccccaggcggcaacatatccgccggcgataccaacacgtaatgttcatggtaaagcggcaccaggtccacagcgtgagtgtcgtcaggcgcggagtgtacgatgacggcatcgagctcaaaatcgcccagccgtcggtgcagttcagtgacaggcagtcgggagcagatttgcacttttatcaatgggtgctccgaacaaaaagccgagaggaccagggacgctgtcgtcgaggcagtaggcaccgtgcctaatcgaagcgtaccagtgatcccggaccgcactgcatgcacctctgccttgaatgcatcgtgttcggcgagaatacgcttggcccacacgaccaggcgctccccttcgggcgttaggccctcaaagctgtgcccccggttaatcagtgtgacgttcagctcacgttcgagtttggcgatcgcggatgagagcgcaggttgcgaaacgtagcacctttcggccgctctggcgaagtgccgctcctgggctaccgcgacgaagtactccagttgacggaagagcacccgtacctcctccctttgggtaccaatctcgctgaggctaacgcgtcgctaccagcccatccaacctacccactcgaagcaaccgcaaatagatttctaacagccaggcgttagctcggtattagcggacaggtggcgatgttgaaactacgaatacttatgtgttgctgctattttcaccacacggagaccaaggcctgccaagttcggagtgctgcgaacagaagaaaatttgtgtttcagttcaacaacattgagcaatgactcaacgataagcaatgagctattattgtctagcacgccgatccacacaaggtacgcaccaaccgcccctcatgctgggacagtgcgcaaaagactacccgaacaaattaatcaacgtttgctaaaacctgtaatgggtagatggccactaaactaactagagtaacgttgtgttgaccgcaccatctcgaagggcggaagccatgtatcaagcggttcgttatctacttgtcatggccgcgatcatcctgatggcggtggcagaatcaggcagccctagcgtggccgctatccctgcactaaagccgacccctgaagttgcttcggtgctgcctactaacggcgcggtggtgggtgtggctcatctggtggtggtgacgttcaccgcaccggtgacggaccgctccgccgctgagcggtcgattcgtataacatcgccgaacaacatgaccggccacttcgagtggcttgatggagatgtcgtgcagtggattccaaccaagtattggcccgcctacactcatgtatcggtcgaggttcaggcgctgacgacgggcttcgaaaccggtgacgcgttgctcggcgttgccagcctgtccacgcacaccttcaccgtcagcagaaacggagaggtactccgtaccatgccggcgtccatgggtaagcccacccggccgacaccgatcggtaagttcaccgcattgtctaaggagcgcaccgtcgtgatggactcacgaaccatcggtattccgctaaattctcccgaagggtatttgatcaccgcgcagtacgcggttcgggttacctggagcggcgtctacgtacactcagccccatggtcggtgaactcacagggttacaccaacgtcagtcatggatgtataaacctaagcccagacgacgccacatggtatttcaacaccgttaacgtcggtgacccgatcgaagtggtggcctaacgtgaggcaaccgcggtgtcgctacgcgaggaacacaacattgtgcggactaacgggcacattacgacggtttgccgacggacttcgtagccgaggtagtcacctcacagtttgcaaaggtgtacggcggctagcggtccgacgacgtgatgaacccacacgatgacgagctattctcggatgtgttcgtggcctggctactcgaagctggccacgacctccagcggatcgatgactatgaccaaataactaaggcgtttcgaacccgctctgcgggctttgcagtacaagcagcggtcagcccattgatagcttatcagaatccggaatagccgacggatattcggctaaaggtagtgcagacagccaaaattgttgtgtataaaagatattccgcatccatcgctggttttaatcgaacaagtacgttacggatctgcggatacttggaccggtttaacccgcgactatgctggctgcgcagtacttgcggggcagccagcctaccgaagagaatccgacattcggatctaaaacgtgcagaaattgggtaagtcgttgaattgaccggcgagccacaacagcagcggaatgatggatgcgaccaccgcgccgtcagcacgtggttgattgaagtcttttcaaggaacgacggctcctcggtggtctagaactggacataggctccctgcttgcaccaagcatgtccgagtgggtttgagatgcgtacacggcaccaacggattatagtaattactggcgctgaataccggtaatttttttactttatagcgctagatcagctgaatatcaaaaatttcttgaccggctcttcattgacaagtttatccatatcgtcgttgaaatatccgcggagattccgtaactggaatttgagcagcttttcatcgatgcattgggggcgagttcttggccagtaaatcttcaccgtacagagtcaacaactcgttaatcactgcagcctattacggataggaataaatggtcccatggagtaaaatccggcgtgccgaacagggcgttgccgtcgatatagtgcagcgtttcggactaggttgacggacaatacatcagaatgggcacccattacattcctcgccccagggcgtaggccaacgcaagtaggtacgctgaggccagcattgtttgtggccaggtcctcatagtcgggtcatgactatgaggacctgcgggctaccagcgtcgctacaaacggattcttcctagctagccatgcagtaacaactacagtggccagtgtattacctggctgaacagccggggtggaacgcaatggtaccctgatcctggatgttcggctcgtagccgagcccccctttccgggaccagggattaatccgggtcgaagtgcgggctggtttatcgtgatcagccggctgcgggagttggtgctgcggtaggcggctttgctgcagcacctgggttgaaggcagggggctcaagcactaaaacctcattggctcggtgcgaatcaactcgggtgggctagactgggcgacaacgagtcgggtggtgtatgggattccgcgtcctgactttgatagccttcgaaataaaattggccttcggtagttcccgacgaacatatctcaccaaacccacggtaacacaaaattaagctaaatgcaggtgcaacaatgaaattaaggtacccgaagcatggccgggagattaccgacggcgccaacgcttaaacaaacagaaccgggaaggaaaacccgcaactaattaagcaatccattttttatcgcggtggcttgctgctaccgaatataggctacaaacccttggatcgatcggatcgttggtacactgtcgaatttaagattcacgaacgctttaccctcgataaattggcataccgacgccggtggagaattgctggtgcagaccgggataaggaaggaggtgctgaccgagcgattgtcattggtagtccgttactgcgaaaattggcgggaacacaagaggccgataaatggccgcacaggcccatggccggaaatgtcttaccacctatgtgtatgtgcgacaacgcataagcttcgatacacaagtaaggagctgaagatgacggcggcggtgatgcgtgttgtgcggttcgaccgttacggaggtcgtagcgtgttataattagccaacgtctatatgccgctgcacagtcgtggcgagatagtgaccgattttcacacagacggcatcaacctccggcgaagacaccagcagcggcggtgcggtgcacgagatagacattcccccgccgagttttcgttcggcgagggccgccgaccttacctgcgtagtgaccgccgtgttgcctgacgtcgtcgagttcttcgtcgacgacgagggcccggggtgcagcttccactgctccagccacgccattcacaccggtggtccgttggggcagttgatcccgaaacctcccttaattgagttgggaggtagctggttcgctgtatgttgtcgagaggcggcgtagacagccttgtcgtgcagttgttggttctgctcaaggagcaaatgttggcatttatagggccaagcaacgccgactgactgcgctcgtgtggcgtcctccggatc

SEQ ID NO: 652 - protein, 7 aa, Artificial Sequence
  Description of Artificial Sequence: Synthetic cognate motif
  MOD_RES (1): Ser or Thr
  MOD_RES (4): Variable amino acid
XRRXFLK

SEQ ID NO: 653 - protein, 4 aa, Unknown Organism
  Description of Unknown Organism: Illustrative peptide
RLEP

SEQ ID NO: 654 - protein, 6 aa, Unknown Organism
  Description of Unknown Organism: Illustrative peptide
REPLEP

SEQ ID NO: 655 - protein, 6 aa, Unknown Organism
  Description of Unknown Organism: Illustrative peptide
LEPREP

The invention claimed is:

1. A recombinant bacterial artificial chromosome (BAC) comprising SEQ ID NO: 645, SEQ ID NO: 646, SEQ ID NO: 647, SEQ ID NO: 648, or SEQ ID NO: 649.

2. A recombinant cosmid comprising SEQ ID NO: 650 or SEQ ID NO: 651.

3. A recombinant purified vector comprising SEQ ID NO: 645, SEQ ID NO: 646, SEQ ID NO: 647, SEQ ID NO: 648, SEQ ID NO: 649, SEQ ID NO: 650, or SEQ ID NO: 651.

4. A host cell transfected or transduced with the vector of claim 3.

5. A method for the production of *mycobacterium* purified marker polypeptide comprising culturing a host cell of claim 4 under conditions promoting expression, and recovering the polypeptide from the culture medium.

6. The method according to claim 5, wherein the host cell is selected from the group consisting of bacterial cells, yeast cells, plant cells, and mammalian cells.

* * * * *